US007879989B2

(12) United States Patent
Meyers et al.

(10) Patent No.: US 7,879,989 B2
(45) Date of Patent: Feb. 1, 2011

(54) 16836, A HUMAN PHOSPHOLIPASE C FAMILY MEMBER, NUCLEIC ACIDS AND USES THEREOF

(75) Inventors: Rachel E. Meyers, Newton, MA (US); John J. Hunter, Newton, CA (US)

(73) Assignee: Millennium Pharmaceuticals, Inc., Cambridge, MA (US)

( * ) Notice: Subject to any disclaimer, the term of this patent is extended or adjusted under 35 U.S.C. 154(b) by 240 days.

(21) Appl. No.: 11/980,299

(22) Filed: Oct. 30, 2007

(65) Prior Publication Data

US 2009/0263860 A1 Oct. 22, 2009

Related U.S. Application Data

(63) Continuation of application No. 10/377,097, filed on Feb. 8, 2003, now abandoned, which is a continuation-in-part of application No. 09/910,150, filed on Jul. 18, 2001, now abandoned, and a continuation-in-part of application No. 10/251,507, filed on Sep. 20, 2002, now abandoned, which is a continuation of application No. 09/715,479, filed on Nov. 17, 2000, now abandoned, said application No. 10/377,097 is a continuation-in-part of application No. 09/644,929, filed on Aug. 23, 2000, now abandoned, and a continuation-in-part of application No. 09/892,870, filed on Jun. 26, 2001, now abandoned, and a continuation-in-part of application No. 09/775,117, filed on Feb. 1, 2001, now abandoned, and a continuation-in-part of application No. 09/822,635, filed on Mar. 30, 2001, now abandoned, and a continuation-in-part of application No. 09/708,222, filed on Nov. 7, 2000, now abandoned, and a continuation-in-part of application No. 10/023,617, filed on Dec. 18, 2001, now abandoned, and a continuation-in-part of application No. 09/838,573, filed on Apr. 18, 2001, now abandoned, and a continuation-in-part of application No. 09/907,509, filed on Jul. 16, 2001, now abandoned, and a continuation-in-part of application No. 09/576,455, filed on May 23, 2000, now abandoned, and a continuation-in-part of application No. 09/834,490, filed on Apr. 13, 2001, now abandoned, and a continuation-in-part of application No. 09/843,158, filed on Apr. 25, 2001, now abandoned, and a continuation-in-part of application No. 09/907,537, filed on Jul. 16, 2001, now abandoned, and a continuation-in-part of application No. 09/999,314, filed on Oct. 22, 2001, now abandoned, and a continuation-in-part of application No. 10/224,539, filed on Aug. 20, 2002, now abandoned, and a continuation-in-part of application No. 09/939,521, filed on Aug. 24, 2001, now abandoned, and a continuation-in-part of application No. 09/882,836, filed on Jun. 15, 2001, now abandoned.

(60) Provisional application No. 60/219,028, filed on Jul. 18, 2000, provisional application No. 60/218,053, filed on Jul. 13, 2000, provisional application No. 60/212,439, filed on Jun. 16, 2000, provisional application No. 60/214,174, filed on Jun. 26, 2000, provisional application No. 60/194,065, filed on Mar. 31, 2000, provisional application No. 60/193,921, filed on Mar. 31, 2000, provisional application No. 60/185,754, filed on Feb. 29, 2000, provisional application No. 60/256,405, filed on Dec. 18, 2000, provisional application No. 60/256,249, filed on Dec. 18, 2000, provisional application No. 60/197,747, filed on Apr. 18, 2000, provisional application No. 60/218,385, filed on Jul. 14, 2000, provisional application No. 60/196,911, filed on Apr. 13, 2000, provisional application No. 60/199,937, filed on Apr. 26, 2000, provisional application No. 60/218,470, filed on Jul. 14, 2000, provisional application No. 60/242,211, filed on Oct. 20, 2000, provisional application No. 60/313,674, filed on Aug. 20, 2001, provisional application No. 60/227,867, filed on Aug. 24, 2000, provisional application No. 60/211,730, filed on Jun. 15, 2000.

(51) Int. Cl.
C07H 21/04 (2006.01)
C12N 5/00 (2006.01)
C12N 15/00 (2006.01)

(52) U.S. Cl. .................... 536/23.5; 435/320.1; 435/325

(58) Field of Classification Search .................. None
See application file for complete search history.

(56) References Cited

U.S. PATENT DOCUMENTS

| 5,952,171 A | 9/1999 | McCarthy et al. ............. 435/6 |
| 2003/0165831 A1 | 9/2003 | Lee et al. | |

FOREIGN PATENT DOCUMENTS

| EP | 0 731 164 A1 | 9/1996 |
| EP | 1 074 617 A2 | 2/2001 |
| WO | WO 96/32485 | 10/1996 |
| WO | WO 98/45436 | 10/1998 |
| WO | WO 99/58675 | 11/1999 |
| WO | WO 00/58473 | 10/2000 |
| WO | WO 01/70979 A2 * | 9/2001 |

OTHER PUBLICATIONS

Ausubel et al, Current Protocols in molecular Biology, 1995, 3rd edition, Wiley & Sons, NY, Section9, p. 9-1 to 9-14.*
Altschul et al., "Basic Local Alignment Search Tool," J. Mol. Biol. 215:403-410 (1990).
Altschul et al., "Gapped BLAST and PSI_BLAST: a new generation of protein database search programs," Nucleic Acids Research, 25(17):3389-3402 (1997).
Chanda (ed.), Current Protocols in Molecular Biology, 2000, vol. 4, John Wiley & Sons, Inc. (Table of Contents only).
Grifman et al., "Functional redundancy of acetylcholinesterase and neuroligin in mammalian neuritogenesis," Proc. Natl. Acad. Sci. USA 95:13935-13940 (Nov. 1998).
International Human Genome Sequencing Consortium, "Initial sequencing and analysis of the human genome," Nature 409:860-921 (Feb. 15, 2001).
Karlin et al., "Applications and statistics for multiple high-scoring segments in molecular sequences," Proc. Natl. Acad. Sci., 90:5873-5877 (Jun. 1993).
Karlin et al., "Methods for assessing the statistical significance of molecular sequence features by using general scoring schemes," Proc. Natl. Acad. Sci., 87:2264-2268 (Mar. 1990).

Myers et al., "Optimal alignments in linear space," CABIOS, 4(1):11-17 (1998).
Rhee et al., "Regulation of Phosphoinositide-specific Phospholipase C Isozymes," J. Biological Chemistry, 272(24):15045-15048 (Jun. 1997).
Sambrook et al. (eds.), "Molecular Cloning—A Laboratory Manual," 1989, 2$^{nd}$ Edition, Cold Spring Harbor Laboratory Press (Table of Contents only).
Shibatohge et al., "Identification of PLC210, a *Caenorhabditis elegans* Phospholipase C, as a Putative Effector of Ras," J. Biological Chemistry 273(11):6218-6222 (Mar. 1998).
Sonnhammer et al., "Pfam: A Comprehensive Database of Protein Domain Families Based on Seed Alignments," Proteins 28:405-420 (1997).
Venter et al., "The Sequence of the Human Genome," Science 291:1304-1351 (Feb. 16, 2001).
Weintraub et al., "Anti-sense RNA as a molecular tool for genetic analysis," Trends in Genetics, (Jan. 1985).
GenBank™ Accession No. AF044576 (Mar. 12, 1998).
GenBank™ Accession No. AK022543 (Aug. 1, 2002).
GenBank™ Accession No. AL050031 (Feb. 18, 2000).
GenBank™ Accession No. AU123289 (Oct. 23, 2000).
GenBank™ Accession No. AU135373 (Oct. 24, 2000).
GenBank™ Accession No. AW243053 (Dec. 14, 1999).
GenBank™ Accession No. AW272589 (Jan. 3, 2000).
GenBank™ Accession No. AW272590 (Jan. 3, 2000).
GenBank™ Accession No. AW889633 (May 24, 2000).
GenBank™ Accession No. AW954633 (Jun. 1, 2000).
GenBank™ Accession No. AX026821 (Sep. 16, 2000).
GenBank™ Accession No. BE544227 (Aug. 7, 2000).
GenBank™ Accession No. BE747934 (Sep. 14, 2000).
GenBank™ Accession No. BF344660 (Nov. 21, 2000).
GenBank™ Accession No. BF922236 (Jan. 19, 2001).
Nagase et al., "Prediction of the Coding Sequences of Unidentified Human Genes. XVII. The Complete Sequences of 100 New cDNA Clones from Brain Which Code for Large Proteins in vitro," DNA Research, 7:143-150, (2000).
Accession No. AAC76412, Feb. 8, 2001.
Accession No. AAH15778, Jun. 26, 2001.
Accession No. AB040949, May 23, 2000.
Accession No. AF117948, Jan. 2, 2000.
Accession No. AF170071, Nov. 2, 2000.
Accession No. AF190642, Oct. 2, 2000.
Accession No. AF233885, Mar. 14, 2000.
Accession No. AL139118, Feb. 10, 2000.
Sequence alignment between SEQ ID No. 1 and Accession AI674036 or AI079952.
Sequence alignment between SEQ ID No. 2 and ABB11191.
Sequence alignment between SEQ ID No. 3 and AF117948 or AAH98533 or AAA02325 or AAV89699.

\* cited by examiner

*Primary Examiner*—Laura B Goddard

(57) ABSTRACT

The invention provides isolated nucleic acids molecules, designated 13237, 18480, 2245, 16228, 7677, 26320, 46619, 33166, 16836, 46867, 21617, 55562, 39228, 62088, 46745, 23155, 21657, 42755, 32229, 22325, 46863 and 32252 nucleic acid molecules. The invention also provides antisense nucleic acid molecules, recombinant expression vectors containing 13237, 18480, 2245, 16228, 7677, 26320, 46619, 33166, 16836, 46867, 21617, 55562, 39228, 62088, 46745, 23155, 21657, 42755, 32229, 22325, 46863 and 32252 nucleic acid molecules, host cells into which the expression vectors have been introduced, and nonhuman transgenic animals in which a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene has been introduced or disrupted. The invention still further provides isolated 13237, 18480, 2245, 16228, 7677, 26320, 46619, 33166, 16836, 46867, 21617, 55562, 39228, 62088, 46745, 23155, 21657, 42755, 32229, 22325, 46863 or 32252 proteins, fusion proteins, antigenic peptides and anti-13237, 18480, 2245, 16228, 7677, 26320, 46619, 33166, 16836, 46867, 21617, 55562, 39228, 62088, 46745, 23155, 21657, 42755, 32229, 22325, 46863 or 32252 antibodies. Diagnostic and therapeutic methods utilizing compositions of the invention are also provided.

8 Claims, No Drawings

16836, A HUMAN PHOSPHOLIPASE C FAMILY MEMBER, NUCLEIC ACIDS AND USES THEREOF

RELATED APPLICATIONS

The present application is a continuation of U.S. patent application Ser. No. 10/377,097, filed Feb. 28, 2003 (abandoned), which is a continuation-in-part of: (i) U.S. patent application Ser. No. 09/910,150, filed Jul. 18, 2001 (abandoned), which claims the benefit of U.S. Provisional Application Ser. No. 60/219,028, filed Jul. 18, 2000 (abandoned); (ii) U.S. patent application Ser. No. 10/251,507, filed Sep. 20, 2002 (abandoned), which is a continuation of U.S. patent application Ser. No. 09/715,479, filed Nov. 17, 2000 (abandoned), which claims the benefit of U.S. Provisional Application Ser. No. 60/218,053, filed Jul. 13, 2000 (abandoned); (iii) U.S. patent application Ser. No. 09/644,929, filed Aug. 23, 2000 (abandoned), which claims the benefit of U.S. Provisional Application Ser. No. 60/212,439, filed Jun. 16, 2000 (abandoned); (iv) U.S. patent application Ser. No. 09/892,870, filed Jun. 26, 2001 (abandoned), which claims the benefit of U.S. Provisional Application Ser. No. 60/214,174, filed Jun. 26, 2000 (abandoned); (v) U.S. patent application Ser. No. 09/775,117, filed Feb. 1, 2001 (abandoned), which claims the benefit of U.S. Provisional Application Ser. No. 60/194,065, filed Mar. 31, 2000 (abandoned); (vi) U.S. patent application Ser. No. 09/822,635, filed Mar. 30, 2001 (abandoned), which claims the benefit of U.S. Provisional Application Ser. No. 60/193,921, filed Mar. 31, 2000 (abandoned); (vii) U.S. patent application Ser. No. 09/708,222, filed Nov. 7, 2000 (abandoned), which claims the benefit of U.S. Provisional Application Ser. No. 60/185,754, filed Feb. 29, 2000 (abandoned); (viii) U.S. patent application Ser. No. 10/023,617, filed Dec. 18, 2001 (abandoned), which claims the benefit of U.S. Provisional Application Ser. No. 60/256,405 and 60/256,249, both filed on Dec. 18, 2000 (abandoned); (ix) U.S. patent application Ser. No. 09/838,573, filed Apr. 18, 2001 (abandoned), which claims the benefit of U.S. Provisional Application Ser. No. 60/197,747, filed Apr. 18, 2000 (abandoned); (x) U.S. patent application Ser. No. 09/907,509, filed Jul. 16, 2001 (abandoned), which claims the benefit of U.S. Provisional Application Ser. No. 60/218,385, filed Jul. 14, 2000 (abandoned); (xi) U.S. patent application Ser. No. 09/576,455, filed May 23, 2000 (abandoned); (xii) U.S. patent application Ser. No. 09/834,490, filed Apr. 13, 2001 (abandoned), which claims the benefit of U.S. Provisional Application Ser. No. 60/196,911, filed Apr. 13, 2000 (abandoned); (xiii) U.S. patent application Ser. No. 09/843,158, filed Apr. 25, 2001 (abandoned), which claims the benefit of U.S. Provisional Application Ser. No. 60/199,937, filed Apr. 26, 2000 (abandoned); (xiv) U.S. patent application Ser. No. 09/907,537, filed Jul. 16, 2001 (abandoned), which claims the benefit of U.S. Provisional Application Ser. No. 60/218,470, filed Jul. 14, 2000 (abandoned); (xv) U.S. patent application Ser. No. 09/999,314, filed Oct. 22, 2001 (abandoned), which claims the benefit of U.S. Provisional Application Ser. No. 60/242,211, filed Oct. 20, 2000 (abandoned); (xvi) U.S. patent application Ser. No. 10/224,539, filed Aug. 20, 2002 (abandoned), which claims the benefit of U.S. Provisional Application Ser. No. 60/313,674, filed Aug. 20, 2001 (abandoned); (xvii) U.S. patent application Ser. No. 09/939,521, filed Aug. 24, 2001 (abandoned), which claims the benefit of U.S. Provisional Application Ser. No. 60/227,867, filed Aug. 24, 2000 (abandoned); and (xviii) U.S. patent application Ser. No. 09/882,836, filed Jun. 15, 2001 (abandoned), which claims the benefit of U.S. Provisional Application Ser. No. 60/211,730, filed Jun. 15, 2000 (abandoned). The entire contents of each of the above-referenced patent applications are incorporated herein by this reference.

BACKGROUND OF THE INVENTION

The enormous variety of biochemical reactions that comprise life are nearly all mediated by a series of biological catalysts known as enzymes. Enzymes are proteins which possess specific catalytic activities that enable them to catalyze a series of reactions, hence enabling metabolic pathways to degrade and to reconstruct products needed to maintain organisms. By the binding of substrates through geometrically and physically complementary reactions, enzymes are stereospecific in binding substrates as well as in catalyzing reactions. The stringency for this stereospecificity varies as some enzymes are more specific to the identity of their substrates, while others are capable of binding multiple substrates and can catalyze numerous types of reactions.

Examples of enzymes include, for example, protein kinases, methyltransferases, dehydrogenases, reductases, acyltransferases, transferases, ATP-ases, carboxylases, synthases and phosphatases. Such enzymes have the ability to, for example: to reversibly phosphorylate proteins in order to regulate protein activity in eukaryotic cells; to catalyze the transfer of an acyl chain to a lipid precursor; to transfer a carboxyl group from an organic substrate, e.g., bicarbonate to a co-factor, e.g., biotin; to oxidize an alcohol group on a substrate molecule; to reduce a carbonyl group on a substrate molecule; to bind a co-enzyme; to participate in the metabolism of a substrate, e.g., a small molecule substrate, e.g., an alcohol, steroid, or fatty acid molecule; to oxidize an alcohol group on a substrate molecule; to hydrolyze ATP, playing a pivotal role in translating chemically stored energy into biological energy; to be involved in a condensation reaction between acyl and malonyl groups to yield beta-ketoacyl derivatives; to catalyze an acyl-CoA ligase or acetoacetyl-CoA synthetase reaction; to catalyze the hydrolysis of phosphatidylinositol; to associate with ras; to mediate guanine nucleotide exchange activity; as well as many others. Accordingly, there exists a need to identify additional human enzymes, for example, for use as disease markers and as targets for identifying various therapeutic modulators.

SUMMARY OF THE INVENTION

The present invention is based, at least in part, on the discovery of novel nucleic acid molecules and proteins encoded by such nucleic acid molecules, referred to herein as "13237, 18480, 2245, 16228, 7677, 26320, 46619, 33166, 16836, 46867, 21617, 55562, 39228, 62088, 46745, 23155, 21657, 42755, 32229, 22325, 46863 or 32252". The 13237, 18480, 2245, 16228, 7677, 26320, 46619, 33166, 16836, 46867, 21617, 55562, 39228, 62088, 46745, 23155, 21657, 42755, 32229, 22325, 46863 or 32252 nucleic acid and protein molecules of the present invention are useful as modulating agents in regulating a variety of cellular processes, e.g., including cell proliferation, differentiation, growth and division. In particular, these nucleic acid molecules will be advantageous in the regulation of any cellular function, uncontrolled proliferation and differentiation, such as in cases of cancer. Accordingly, in one aspect, this invention provides isolated nucleic acid molecules encoding 13237, 18480, 2245, 16228, 7677, 26320, 46619, 33166, 16836, 46867, 21617, 55562, 39228, 62088, 46745, 23155, 21657, 42755, 32229, 22325, 46863 or 32252 proteins or biologically active portions thereof, as well as nucleic acid fragments suitable as primers or hybridization probes for the detection of 13237, 18480, 2245, 16228, 7677, 26320, 46619, 33166, 16836, 46867, 21617, 55562, 39228, 62088, 46745, 23155, 21657, 42755, 32229, 22325, 46863 or 32252-encoding nucleic acids.

The nucleotide sequence of the cDNA encoding 13237, 18480, 2245, 16228, 7677, 26320, 46619, 33166, 16836, 46867, 21617, 55562, 39228, 62088, 46745, 23155, 21657, 42755, 32229, 22325, 46863 or 32252, and the amino acid sequence of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptides are depicted in Table 1.

ants) to the nucleotide sequence shown in SEQ ID NO:1, 3, 4, 6, 7, 9, 10, 12, 39, 41, 54, 56, 58, 59, 61, 63, 65, 66, 68, 75, 77, 79, 81, 82, 84, 89, 91, 92, 94, 95, 97, 107, 109, 112, 114, 117, 119, 120, 122, 127, 129, 139, 141, 151 or 153 or the nucleotide sequence of the DNA insert of the plasmid deposited with ATCC Accession Number PTA-3436, PTA-2339, PTA-1774, PTA-1681 or PTA-3425. In other embodiments, the invention provides a nucleic acid molecule which hybridizes under a stringent hybridization condition as described herein to a nucleic acid molecule comprising the nucleotide sequence of SEQ ID NO: 1, 3, 4, 6, 7, 9, 10, 12, 39, 41, 54, 56, 58, 59, 61, 63, 65, 66, 68, 75, 77, 79, 81, 82, 84, 89, 91, 92, 94, 95, 97, 107, 109, 112, 114, 117, 119, 120, 122, 127, 129, 139,

TABLE 1

Sequences of the invention

| Gene Name | cDNA | Protein | Coding Region | ATCC accession number |
|---|---|---|---|---|
| 13237 | SEQ ID NO: 1 | SEQ ID NO: 2 | SEQ ID NO: 3 | N/A |
| 18480 | SEQ ID NO: 4 | SEQ ID NO: 5 | SEQ ID NO: 6 | N/A |
| 2245 | SEQ ID NO: 7 | SEQ ID NO: 8 | SEQ ID NO: 9 | N/A |
| 16228 | SEQ ID NO: 10 | SEQ ID NO: 11 | SEQ ID NO: 12 | N/A |
| 7677 | SEQ ID NO: 39 | SEQ ID NO: 40 | SEQ ID NO: 41 | N/A |
| 26320 | SEQ ID NO: 54 | SEQ ID NO: 55 & SEQ ID NO: 57 | SEQ ID NO: 56 & SEQ ID NO: 58 | PTA-3436 |
| 46619 | SEQ ID NO: 59 | SEQ ID NO: 60 | SEQ ID NO: 61 | N/A |
| 33166 | SEQ ID NO: 63 | SEQ ID NO: 64 | SEQ ID NO: 65 | PTA-2339 |
| 16836 | SEQ ID NO: 66 | SEQ ID NO: 67 | SEQ ID NO: 68 | PTA-1774 |
| 46867 | SEQ ID NO: 75 | SEQ ID NO: 76 | SEQ ID NO: 77 | PTA-1681 |
| 21617 | SEQ ID NO: 79 | SEQ ID NO: 80 | SEQ ID NO: 81 | N/A |
| 55562 | SEQ ID NO: 82 | SEQ ID NO: 83 | SEQ ID NO: 84 | N/A |
| 39228 | SEQ ID NO: 89 | SEQ ID NO: 90 | SEQ ID NO: 91 | N/A |
| 62088 | SEQ ID NO: 92 | SEQ ID NO: 93 | SEQ ID NO: 94 | N/A |
| 46745 | SEQ ID NO: 95 | SEQ ID NO: 96 | SEQ ID NO: 97 | N/A |
| 23155 | SEQ ID NO: 107 | SEQ ID NO: 108 | SEQ ID NO: 109 | N/A |
| 21657 | SEQ ID NO: 112 | SEQ ID NO: 113 | SEQ ID NO: 114 | N/A |
| 42755 | SEQ ID NO: 117 | SEQ ID NO: 118 | SEQ ID NO: 119 | N/A |
| 32229 | SEQ ID NO: 120 | SEQ ID NO: 121 | SEQ ID NO: 122 | N/A |
| 22325 | SEQ ID NO: 127 | SEQ ID NO: 128 | SEQ ID NO: 129 | N/A |
| 46863 | SEQ ID NO: 139 | SEQ ID NO: 140 | SEQ ID NO: 141 | N/A |
| 32252 | SEQ ID NO: 151 | SEQ ID NO: 152 | SEQ ID NO: 153 | PTA-3425 |

Accordingly, in one aspect, the invention features a nucleic acid molecule which encodes a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein or polypeptide, e.g., a biologically active portion of the 13237, 18480, 2245, 16228, 7677, 26320, 46619, 33166, 16836, 46867, 55562, 21617, 39228, 62088, 46745, 3213, 23155, 21657, 42755, 32229, 22325, 46863 or 32252 protein. In a preferred embodiment, the isolated nucleic acid molecule encodes a polypeptide having the amino acid sequence of SEQ ID NO:2, 5, 8, 11, 40, 55, 57, 60, 64, 67, 76, 80, 83, 90, 93, 96, 108, 113, 118, 121, 128, 140 or 152. In other embodiments, the invention provides isolated 13237, 18480, 2245, 16228, 7677, 26320, 46619, 33166, 16836, 46867, 21617, 55562, 39228, 62088, 46745, 23155, 21657, 42755, 32229, 22325, 46863 or 32252 nucleic acid molecules having the nucleotide sequence shown in SEQ ID NO:1, 3, 4, 6, 7, 9, 10, 12, 39, 41, 54, 56, 58, 59, 61, 63, 65, 66, 68, 75, 77, 79, 81, 82, 84, 89, 91, 92, 94, 95, 97, 107, 109, 112, 114, 117, 119, 120, 122, 127, 129, 139, 141, 151 or 153 or the nucleotide sequence of the DNA insert of the plasmid deposited with ATCC Accession Number PTA-3436, PTA-2339, PTA-1774, PTA-1681 or PTA-3425. In still other embodiments, the invention provides nucleic acid molecules that are substantially identical (e.g., naturally occurring allelic vari- 141, 151 or 153 or the nucleotide sequence of the DNA insert of the plasmid deposited with ATCC Accession Number PTA-3436, PTA-2339, PTA-1774, PTA-1681 or PTA-3425, wherein the nucleic acid encodes a full length 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein or an active fragment thereof.

In a related aspect, the invention further provides nucleic acid constructs which include a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 nucleic acid molecule described herein. In certain embodiments, the nucleic acid molecules of the invention are operatively linked to native or heterologous regulatory sequences. Also included are vectors and host cells containing the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 nucleic acid molecules of the invention e.g., vectors and host cells suitable for producing polypeptides.

In another related aspect, the invention provides nucleic acid fragments suitable as primers or hybridization probes for the detection of 13237, 18480, 2245, 16228, 7677, 26320, 46619, 33166, 16836, 46867, 21617, 55562, 39228, 62088, 46745, 23155, 21657, 42755, 32229, 22325, 46863 or 32252-encoding nucleic acids.

In still another related aspect, isolated nucleic acid molecules that are antisense to a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 encoding nucleic acid molecule are provided.

In another aspect, the invention features 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptides, and biologically active or antigenic fragments thereof that are useful, e.g., as reagents or targets in assays applicable to treatment and diagnosis of 13237, 18480, 2245, 16228, 7677, 26320, 46619, 33166, 16836, 46867, 21617, 55562, 39228, 62088, 46745, 23155, 21657, 42755, 32229, 22325, 46863 or 32252-associated disorders. In another embodiment, the invention provides 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptides having a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 activity.

In other embodiments, the invention provides 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptides, e.g., a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptide having the amino acid sequence shown in SEQ ID NO:2, 5, 8, 11, 40, 55, 57, 60, 64, 67, 76, 80, 83, 90, 93, 96, 108, 113, 118, 121, 128, 140 or 152 or the amino acid sequence encoded by the cDNA insert of the plasmid deposited with ATCC Accession Number PTA-3436, PTA-2339, PTA-1774, PTA-1681 or PTA-3425; an amino acid sequence that is substantially identical to the amino acid sequence shown in SEQ ID NO:2, 5, 8, 11, 40, 55, 57, 60, 64, 67, 76, 80, 83, 90, 93, 96, 108, 113, 118, 121, 128, 140 or 152 or the amino acid sequence encoded by the cDNA insert of the plasmid deposited with ATCC Accession Number PTA-3436, PTA-2339, PTA-1774, PTA-1681 or PTA-3425; or an amino acid sequence encoded by a nucleic acid molecule having a nucleotide sequence which hybridizes under a stringent hybridization condition as described herein to a nucleic acid molecule comprising the nucleotide sequence of SEQ ID NO:1, 3, 4, 6, 7, 9, 10, 12, 39, 41, 54, 56, 58, 59, 61, 63, 65, 66, 68, 75, 77, 79, 81, 82, 84, 89, 91, 92, 94, 95, 97, 107, 109, 112, 114, 117, 119, 120, 122, 127, 129, 139, 141, 151 or 153 or the nucleotide sequence of the insert of the plasmid deposited with ATCC Accession Number PTA-3436, PTA-2339, PTA-1774, PTA-1681 or PTA-3425, wherein the nucleic acid encodes a full length 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein or an active fragment thereof.

In a related aspect, the invention further provides nucleic acid constructs which include a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 nucleic acid molecule described herein.

In a related aspect, the invention provides 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptides or fragments operatively linked to non-13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptides to form fusion proteins.

In another aspect, the invention features antibodies and antigen-binding fragments thereof, that react with, or more preferably specifically or selectively bind 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptides.

In another aspect, the invention provides methods of screening for compounds that modulate the expression or activity of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptides or nucleic acids.

In still another aspect, the invention provides a process for modulating 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptide or nucleic acid expression or activity, e.g., using the compounds identified in the screens described herein. In certain embodiments, the methods involve treatment of conditions related to aberrant activity or expression of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptides or nucleic acids, such as conditions or disorders involving aberrant or deficient 13237, 18480, 2245, 16228, 7677, 26320, 46619, 33166, 16836, 46867, 21617, 55562, 39228, 62088, 46745, 23155, 21657, 42755, 32229, 22325, 46863 or 32252 expression. Examples of such disorders include, but are not limited to cellular proliferative and/or differentiative disorders, brain disorders, blood vessel disorders, platelet disorders, breast disorders, colon disorders, kidney disorders, lung disorders, ovarian disorders, prostate disorders, hematopoeitic disorders, pancreatic disorders, skeletal muscle disorders, testicular disorders, skin disorders, eye disorders, hormonal disorders, disorders associated with bone metabolism, immune e.g., inflammatory, disorders, cardiovascular disorders, endothelial cell disorders, liver disorders, viral diseases, pain or metabolic disorders.

The invention also provides assays for determining the activity of or the presence or absence of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptides or nucleic acid molecules in a biological sample, including for disease diagnosis.

In a further aspect, the invention provides assays for determining the presence or absence of a genetic alteration in a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptide or nucleic acid molecule, including for disease diagnosis.

In another aspect, the invention features a two dimensional array having a plurality of addresses, each address of the plurality being positionally distinguishable from each other address of the plurality, and each address of the plurality having a unique capture probe, e.g., a nucleic acid or peptide sequence. At least one address of the plurality has a capture probe that recognizes a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 molecule. In one embodiment, the capture probe is a nucleic acid, e.g., a probe complementary to a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 nucleic acid sequence. In another embodiment, the capture probe is a polypeptide, e.g., an antibody specific for 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptides. Also featured is a method of analyzing a sample by contacting the sample to the aforementioned array and detecting binding of the sample to the array.

Other features and advantages of the invention will be apparent from the following detailed description, and from the claims.

DETAILED DESCRIPTION OF THE INVENTION

Human 13237

The human 13237 sequence (SEQ ID NO:1), which is approximately 3637 nucleotides long including untranslated regions, contains a predicted methionine-initiated coding sequence of about 3201 nucleotides (nucleotides 77-3277 of SEQ ID NO:1; nucleotides 1-3201 of SEQ ID NO:3), not including the terminal codon. The coding sequence encodes a 1066 amino acid protein (SEQ ID NO:2).

This mature protein form is approximately 1066 amino acid residues in length (from about amino acid 1 to amino acid 1066 of SEQ ID NO:2). The 13237 protein includes the following domains: one predicted protein kinase domain (PFAM Accession Number PF00069) located at about amino acid residues 385-418 and 906-1056 of SEQ ID NO:2; four N-glycosylation sites (PS00001) located at about amino acids 131-134, 196-199, 646-649 and 812-815 of SEQ ID NO:2; four cAMP- and cGMP-dependent protein kinase phosphorylation sites (PS00004) located at about amino acids 52-55, 290-293, 367-370 and 434-437 of SEQ ID NO:2; fourteen predicted protein kinase C phosphorylation sites (PS00005) located at about amino acids 3-5, 33-35, 38-40, 229-231, 284-286, 323-325, 494-496, 583-585, 623-625, 672-674, 701-703, 764-766, 837-839 and 996-998 of SEQ ID NO:2; thirty-two predicted casein kinase II phosphorylation sites (PS00006) located at about amino 3-6, 16-19, 93-96, 146-149, 150-153, 161-164, 174-177, 209-212, 214-217, 284-287, 332-335, 355-358, 423-426, 449-452, 454-457, 479-482, 484-487, 502-505, 528-531, 596-599, 608-611, 634-637, 650-653, 672-675, 682-685, 701-704, 762-765, 785-788, 868-871, 952-955, 999-1002 and 1057-1060 of SEQ ID NO:2; one predicted tyrosine kinase phosphorylation site (PS00007) located at about amino acids 252-259 of SEQ ID NO:2; fourteen predicted N-myristoylation sites (PS00008) located at about amino acids 84-89, 127-132, 181-186, 194-199, 205-210, 320-325, 365-370, 460-465, 614-619, 663-668, 683-688, 719-724, 803-808 and 1041-1046 of SEQ ID NO:2; and one predicted amidation site (PS00009) located at about amino acids 234-237 of SEQ ID NO:2.

For general information regarding PFAM identifiers, PS prefix and PF prefix domain identification numbers, refer to Sonnhammer et al. (1997) *Protein* 28:405-420.

In one embodiment, a 13237 family member can include at least one protein kinase domain (PFAM Accession Number PF00069). Furthermore, a 13237 family member can include at least one, two, three, and preferably four N-glycosylation sites (PS00001); at least one, two and preferably three cAMP- and cGMP-dependent protein kinase phosphorylation sites; at least one, two, three, four, five, six, seven, eight, nine, ten, eleven, twelve, thirteen, and preferably fourteen protein kinase C phosphorylation sites (PS00005); at least one, two, three, four, five, six, seven, eight, nine, ten, eleven, twelve, thirteen, fourteen, fifteen, sixteen, seventeen, eighteen, nineteen, twenty, twenty-one, twenty-two, twenty-three, twenty-four, twenty-five, twenty-six, twenty-seven, twenty-eight, twenty-nine, thirty, thirty-one and preferably thirty-two casein kinase II phosphorylation sites (PS00006); at least one tyrosine kinase phosphorylation site (PS00007); at least one, two, three, four, five, six, seven, eight, nine, ten, eleven, twelve, thirteen, and preferably fourteen N-myristolyation sites (PS00008); and at least one amidation site (PS00009).

A hydropathy plot of human 13237 reveals the hydrophobic and hydrophilic areas of the molecule. Polypeptides of the invention include fragments which include: all or part of a hydrophobic sequence, e.g., the sequence from about amino acid 340 to 350, from about 380 to 390, and from about 985 to 995 of SEQ ID NO:2; all or part of a hydrophilic sequence, e.g., the sequence from about amino acid 280 to 290, from about 480 to 500, and from about 740 to 770 of SEQ ID NO:2; a sequence which includes a Cys, or a glycosylation site.

In another embodiment, the isolated proteins of the present invention, preferably 13237 proteins, are identified based on the presence of at least one Ser/Thr kinase site. As used herein, the term "Ser/Thr kinase site" includes an amino acid sequence of about 200-400 amino acid residues in length, preferably 200-300 amino acid residues in length, and more preferably 250-300 amino acid residues in length, which is conserved in kinases which phosphorylate serine and threonine residues and found in the catalytic domain of Ser/Thr kinases. Preferably, the Ser/Thr kinase site includes the following amino acid consensus sequence $X_9$-g-X-G-$X_4$-V-$X_{12}$-K-X-$_{(10-19)}$-E-$X_{66}$-h-$X_8$-h-r-D-X-K-$X_2$-N-$X_{17}$-K-$X_2$-D-f-g-$X_{21}$-p-$X_{13}$-w-$X_3$-g-$X_{55}$-R-$X_{14}$-h-$X_3$ (SEQ ID NO:37) (where invariant residues are indicated by upper case letters and nearly invariant residues are indicated by lower case letters). In the above conserved motifs, and other motifs described herein, the standard IUPAC one-letter code for the amino acids is used. Each element in the pattern is separated by a dash (-); square brackets ([ ]) indicate the particular residues that are accepted at that position; x indicates that any residue is accepted at that position; and numbers in parentheses (( )) indicate the number of residues represented by the accompanying amino acid. The nearly invariant residues are usually found in most Ser/Thr kinase sites, but can be replaced by other amino acids which, preferably, have similar characteristics. For example, a nearly invariant hydrophobic amino acid in the above amino acid consensus sequence would most likely be replaced by another hydrophobic amino acid. Ser/Thr kinase domains are described in, for example, Levin D. E. et al. (1990) *Proc. Natl. Acad. Sci. USA* 87:8272-76, the contents of which are incorporated herein by reference. Amino acid residues 861 to 1056 of the 13237 protein comprise a Ser/Thr kinase domain.

Accordingly, another embodiment of the invention features isolated 13237 proteins and polypeptides having a 13237 activity. Preferred proteins are 13237 proteins having at least one Ser/Thr kinase. Additional preferred proteins have at least one Ser/Thr kinase site and preferably a 13237 activity. Additional preferred proteins have at least one Ser/Thr kinase site and are, preferably, encoded by a nucleic acid molecule having a nucleotide sequence which hybridizes under stringent hybridization conditions to a nucleic acid molecule comprising the nucleotide sequence of SEQ ID NO:1 or SEQ ID NO:3.

The nucleic acid encodes a polypeptide with similarities known Ser/Thr kinases. Thus the 13237 encoded polypeptide is expected to be a kinase and function in the phosphorylation of protein substrates. Additionally, the 13237 nucleic acids can be used in known or novel screens and assays for kinase encoding nucleic acids to distinguish it from other distinct

Human 18480

The human 18480 sequence (SEQ ID NO:4), which is approximately 2438 nucleotides long including untranslated regions, contains a predicted methionine-initiated coding sequence of about 2079 nucleotides (nucleotides 45-2123 of SEQ ID NO:4; nucleotides 1-2079 of SEQ ID NO:6), not including the terminal codon. The coding sequence encodes a 692 amino acid protein (SEQ ID NO:5).

This mature protein form is approximately 692 amino acid residues in length (from about amino acid 1 to amino acid 692 of SEQ ID NO:5). The 18480 protein includes the following domains: one predicted protein kinase domain (PFAM Accession Number PF00069) located at about amino acid residues 4 to 258 of SEQ ID NO:5; one cAMP-dependent protein kinase phosphorylation site (PS00004) located at about amino acids 598-601 of SEQ ID NO:5; thirteen predicted protein kinase C phosphorylation sites (PS00005) located at about amino acids 155-157, 198-200, 224-226, 271-273, 292-294, 342-344, 350-352, 392-394, 407-409, 460-462, 472-474, 521-523 and 597-599 of SEQ ID NO:5; eight predicted casein kinase II phosphorylation sites (PS00006) located at about amino 41-44, 87-90, 98-101, 427-430, 435-438, 460-463, 533-536 and 684-687 of SEQ ID NO:5; thirteen predicted N-myristoylation sites (PS00008) located at about amino acids 85-90, 287-292, 318-323, 346-351, 362-367, 410-415, 416-421, 478-483, 503-508, 514-519, 569-574, 591-596 and 612-617 of SEQ ID NO:5; one predicted amidation site (PS00009) located at about amino acids 645-648 of SEQ ID NO:5; one predicted prokaryotic membrane lipoprotein lipid attachment site (PS00013) located at about amino acids 663-673 of SEQ ID NO:5; one cell attachment site (PS00016) located at about amino acids 469-471 of SEQ ID NO:5; one ATP-binding region signature site (PS00107) located at about amino acids 10-18 of SEQ ID NO:5; and one serine/threonine kinase active site signature located at about amino acids 124-136 of SEQ ID NO:5.

In one embodiment, a 18480 family member can include at least one protein kinase domain (PFAM Accession Number PF00069). Furthermore, a 18480 family member can include at least one cAMP-dependent protein kinase phosphorylation site (PS00004); at least one, two, three, four, five, six, seven, eight, nine, ten, eleven, twelve, and preferably thirteen protein kinase C phosphorylation sites (PS00005); at least one, two, three, four, five, six, seven, and preferably eight casein kinase II phosphorylation sites (PS00006); at least one, two, three, four, five, six, seven, eight, nine, ten, eleven, twelve, and preferably thirteen N-myristolyation sites (PS00008); at least one amidation site (PS00009); at least one prokaryotic membrane lipoprotein lipid attachment site (PS00013); at least one cell attachment site (PS00016); at least one ATP-binding region signature site (PS00107); at least one serine/threonine kinase active site signature In another embodiment, the isolated proteins of the present invention, preferably 18480 proteins, are identified based on the presence of at least one Ser/Thr kinase site and at least one ATP-binding region.

As used herein, the term "ATP-binding region" includes an amino acid sequence of about 20-40, preferably 20-30, and more preferably 25-30 amino acid residues in length, present in enzymes which activate their substrates by phosphorylation, and involved in binding adenosine triphosphate (ATP). ATP-binding regions preferably include the following amino acid consensus sequence: G-X-G-X-X-G-X(15-23)-K [SEQ ID NO:38]. ATP-binding regions are described in, for example, Samuel K. P. et al. (1987) *FEBS Let.* 218(1): 81-86, the contents of which are incorporated herein by reference. Amino acid residues 10 to 18 of comprise an ATP-binding region. Amino acid residues 124 to 136 of the 18480 protein comprise a Ser/Thr kinase domain.

A hydropathy plot of human 18480 reveals the hydrophobic and hydrophilic areas of the molecule. Polypeptides of the invention include fragments which include: all or part of a hydrophobic sequence, e.g., the sequence from about amino acid 10 to 20, from about 95 to 120, and from about 500 to 520 of SEQ ID NO:5; all or part of a hydrophilic sequence, e.g., the sequence from about amino acid 40 to 55, from about 475 to 495, and from about 590 to 600 of SEQ ID NO:5; a sequence which includes a Cys, or a glycosylation site.

Accordingly, another embodiment of the invention features isolated 18480 proteins and polypeptides having a 18480 activity. Preferred proteins are 18480 proteins having at least one Ser/Thr kinase and at least one ATP-binding region. Additional preferred proteins have at least one Ser/Thr kinase site, at least one ATP-binding region, and preferably a 18480 activity. Additional preferred proteins have at least one Ser/Thr kinase site, at least one ATP-binding region, and are, preferably, encoded by a nucleic acid molecule having a nucleotide sequence which hybridizes under stringent hybridization conditions to a nucleic acid molecule comprising the nucleotide sequence of SEQ ID NO:4 or SEQ ID NO:6.

The nucleic acid encodes a polypeptide with similarities known Ser/Thr kinases. Thus the 18480 encoded polypeptide is expected to be a kinase and function in the phosphorylation of protein substrates. Additionally, the 18480 nucleic acids can be used in known or novel screens and assays for kinase encoding nucleic acids to distinguish it from other distinct nucleic acids. Alternatively, the nucleic acid sequences can be used in the preparation of phylogenetic trees and relationships between organisms.

Human 2245

The human 2245 sequence (SEQ ID NO:7), which is approximately 1334 nucleotides long including untranslated regions, contains a predicted methionine-initiated coding sequence of about 1278 nucleotides (nucleotides 1-1278 of SEQ ID NO:7; SEQ ID NO:9), not including the terminal codon. The coding sequence encodes a 425 amino acid protein (SEQ ID NO:8).

This mature protein form is approximately 425 amino acid residues in length (from about amino acid 1 to amino acid 425 of SEQ ID NO:8).

The 2245 protein also includes the following domains: one predicted protein kinase domain (PFAM Accession Number PF00069) located at about amino acid residues 93 to 414 of SEQ ID NO:8; one transmembrane domain (predicted by MEMSAT, Jones et al. (1994) *Biochemistry* 33:3038-3049) at about amino acids 328 to 345 of SEQ ID NO:8; two N-glycosylation sites (PS00001) located at about amino acids 173-176 and 228-231 of SEQ ID NO:8; three cAMP- and cGMP-dependent protein kinase phosphorylation sites (PS00004) located at about amino acids 33-36, 42-45 and 384-387 of SEQ ID NO:8; ten predicted protein kinase C phosphorylation sites (PS00005) located at about amino acids 27-29, 52-54, 88-90, 144-146, 186-188, 220-222, 227-229, 260-262, 323-325 and 349-351 of SEQ ID NO:8; five predicted casein kinase II phosphorylation sites (PS00006) located at about amino 27-30, 343-346, 349-352, 388-391 and 416-419 of SEQ ID NO:8; seven predicted N-myristoylation sites (PS00008) located at about amino acids 9-14, 31-36, 84-89, 116-121, 172-177, 211-216 and 289-294 of SEQ ID NO:8; one predicted amidation site (PS00009) located at about amino acids 2-5 of SEQ ID NO:8; one protein kinase ATP-binding region signature (PS00107) located at about amino acids 99-107 of SEQ ID NO:8; one predicted serine/threonine protein kinase active-site sign (PS00108) located at about amino acids 247-259 of SEQ ID NO:8; and three dileucine motifs in the tail located at about amino acids 353-354, 371-372, and 396-937 of SEQ ID NO:8.

In one embodiment, a 2245 family member can include at least one protein kinase domain (PFAM Accession Number PF00069) and at least one transmembrane domain. Furthermore, a 2245 family member can include at least one and preferably two N-glycosylation sites (PS00001); at least one, two and preferably three cAMP- and cGMP-dependent protein kinase phosphorylation sites (PS00004); at least one, two, three, four, five, six, seven, eight, nine, and preferably ten protein kinase C phosphorylation sites (PS00005); at least one, two, three, four, and preferably five casein kinase II phosphorylation sites (PS00006); at least one, two, three, four, five, six, and preferably seven N-myristolyation sites (PS00008); at least one amidation site (PS00009); at least one protein kinase ATP-binding region signature (PS00107); at least one serine/threonine protein kinase active-site sign (PS00108); at least one, two and preferably three dileucine motifs in the tail.

A hydropathy plot of human 2245 reveals the hydrophobic and hydrophilic areas of the molecule. Polypeptides of the invention include fragments which include: all or part of a hydrophobic sequence, e.g., the sequence from about amino acid 130 to 140, from about 260 to 280, and from about 325 to 335 of SEQ ID NO:8; all or part of a hydrophilic sequence, e.g., the sequence from about amino acid 30 to 50, from about 80 to 95, and from about 285 to 300 of SEQ ID NO:8; a sequence which includes a Cys, or a glycosylation site.

A 2245 polypeptide can include at least one "transmembrane domain" or region homologous with a "transmembrane domain". As used herein, the term "transmembrane domain" includes an amino acid sequence of about 10 to 40 amino acid residues in length and spans the plasma membrane. Transmembrane domains are rich in hydrophobic residues, e.g., at least 50%, 60%, 70%, 80%, 90%, 95% or more of the amino acids of a transmembrane domain are hydrophobic, e.g., leucines, isoleucines, tyrosines, or tryptophans. Transmembrane domains typically have alpha-helical structures and are described in, for example, Zagotta, W. N. et al., (1996) *Annual Rev. Neurosci.* 19:235-263, the contents of which are incorporated herein by reference.

In a preferred embodiment, a 2245 polypeptide or protein has at least one or two "transmembrane domains" or regions which include at least about 12 to 35 more preferably about 14 to 30 or 15 to 25 amino acid residues and has at least about 60%, 70% 80% 90% 95%, 99%, or 100% homology with a "transmembrane domain," e.g., the transmembrane domains of human 2245 (e.g., residues 328 to 345 of SEQ ID NO:8).

To identify the presence of a "transmembrane" domain in a 2245 protein sequence, and make the determination that a polypeptide or protein of interest has a particular profile, the amino acid sequence of the protein can be analyzed by a transmembrane prediction method that predicts the secondary structure and topology of integral membrane proteins based on the recognition of topological models (MEMSAT, Jones et al., (1994) *Biochemistry* 33:3038-3049).

A mature 2245 polypeptide can include at least one, preferably two "non-transmembrane regions." As used herein, the term "non-transmembrane region" includes an amino acid sequence not identified as a transmembrane domain. The non-transmembrane regions in 2245 are located at about amino acids 1 to 327 and 346 to 425 of SEQ ID NO:8.

The non-transmembrane regions of 2245 include at least one cytoplasmic region.

In a preferred embodiment, a 2245 polypeptide or protein has a C-terminal cytoplasmic domain or a region which includes at least about 5, preferably about 10 to 100, and more preferably about 50 to 100 amino acid residues and has at least about 60%, 70% 80% 90% 95%, 99%, or 100% homology with a C-terminal cytoplasmic domain," e.g., the C-terminal cytoplasmic domain of human 2245 (e.g., residues 346 to 425 of SEQ ID NO:8).

As used herein, "non-transmembrane domains" are domains that reside outside of the membrane. When referring to plasma membranes, non-transmembrane domains include extracellular domains (i.e., outside of the cell) and intracellular domains (i.e., within the cell). When referring to membrane-bound proteins found in intracellular organelles (e.g., mitochondria, endoplasmic reticulum, peroxisomes and microsomes), non-transmembrane domains include those domains of the protein that reside in the cytosol (i.e., the cytoplasm), the lumen of the organelle, or the matrix or the intermembrane space (the latter two relate specifically to mitochondria organelles). The C-terminal amino acid residue of a non-transmembrane domain is adjacent to an N-terminal amino acid residue of a transmembrane domain in a naturally-occurring 2245, or 2245-like protein.

In a preferred embodiment, a 2245 polypeptide or protein has a "non-transmembrane domain" or a region which includes at least about 100-500 or 1-200, preferably about 150-450 or 1-150, more preferably about 200-400 or 1-100, and even more preferably about 250-350 or 50-100 amino acid residues, and has at least about 60%, 70% 80% 90% 95%, 99% or 100% homology with a "non-transmembrane domain", e.g., a non-transmembrane domain of human 2245 (e.g., residues 1-327 and 346-425 of SEQ ID NO:8). Preferably, a non-transmembrane domain is capable of catalytic activity (e.g., catalyzing a kinase reaction).

A non-transmembrane domain located at the N-terminus of a 2245 protein or polypeptide is referred to herein as an "N-terminal non-transmembrane domain." As used herein, an "N-terminal non-transmembrane domain" includes an amino acid sequence having about 100-500, preferably about 150-450, more preferably about 200-400, or even more preferably about 250-350 amino acid residues in length and is located outside the boundaries of a membrane. For example, an N-terminal non-transmembrane domain is located at about amino acid residues 1-327 of SEQ ID NO:8.

Similarly, a non-transmembrane domain located at the C-terminus of a 2245 protein or polypeptide is referred to herein as a "C-terminal non-transmembrane domain." As used herein, a "C-terminal non-transmembrane domain" includes an amino acid sequence having about 1-200, preferably about 1-150, preferably about 1-100, more preferably about 50-100 amino acid residues in length and is located outside the boundaries of a membrane. For example, an C-terminal non-transmembrane domain is located at about amino acid residues 346-425 of SEQ ID NO:8.

In another embodiment, the isolated proteins of the present invention, preferably 2245 proteins, are identified based on the presence of at least one Ser/Thr kinase site and at least one ATP-binding region.

Accordingly, another embodiment of the invention features isolated 2245 proteins and polypeptides having a 2245 activity. Preferred proteins are 2245 proteins having at least one Ser/Thr kinase and at least one ATP-binding region. Additional preferred proteins have at least one Ser/Thr kinase site, at least one ATP-binding region, and preferably a 2245 activity. Additional preferred proteins have at least one Ser/Thr kinase site, at least one ATP-binding region, and are, preferably, encoded by a nucleic acid molecule having a nucleotide sequence which hybridizes under stringent hybridization conditions to a nucleic acid molecule comprising the nucleotide sequence of SEQ ID NO:7 or SEQ ID NO:9. Amino acid residues 99 to 107 of comprise an ATP-binding region. Amino acid residues 247 to 259 of the 2245 protein comprise a Ser/Thr kinase domain.

The nucleic acid encodes a polypeptide with similarities known Ser/Thr kinases. Thus the 2245 encoded polypeptide is expected to be a kinase and function in the phosphorylation of protein substrates. Additionally, the 2245 nucleic acids can be used in known or novel screens and assays for kinase encoding nucleic acids to distinguish it from other distinct nucleic acids. Alternatively, the nucleic acid sequences can be used in the preparation of phylogenetic trees and relationships between organisms.

Human 16228

The human 16228 sequence (SEQ ID NO:10), which is approximately 3301 nucleotides long including untranslated regions, contains a predicted methionine-initiated coding sequence of about 2781 nucleotides (nucleotides 36-2816 of SEQ ID NO:10; nucleotides 1-2781 of SEQ ID NO:12), not including the terminal codon. The coding sequence encodes a 926 amino acid protein (SEQ ID NO:11).

The mature protein form is approximately 890 amino acid residues in length (from about amino acid 35 to amino acid 926 of SEQ ID NO:11). Human 16228 includes the following domains: predicted transmembrane domain which extend from about amino acid residue 201 (cytoplasmic end) to about amino acid residue 221 (extracellular end) of SEQ ID NO: 11; from about amino acid residue 433 (extracellular end) to about amino acid residue 451 (cytoplasmic end) of SEQ ID NO:11; one extracellular loop found at about amino acids 202-220 of SEQ ID NO:11; and a C-terminal cytoplasmic domain is found at about amino acid residues 451-926 of SEQ ID NO:11.

The 16228 protein also includes the following domains: one predicted protein kinase domain (PFAM Accession Number PF00069) located at about amino acid residues 93 to 414 of SEQ ID NO:11; one or two transmembrane domains (predicted by MEMSAT, Jones et al. (1994) *Biochemistry* 33:3038-3049) at about amino acids 201 to 221 and/or 433 to 451 of SEQ ID NO:11; one N-glycosylation site (PS00001) located at about amino acid 179-182 of SEQ ID NO:11; one cAMP- and cGMP-dependent protein kinase phosphorylation site (PS00004) located at about amino acids 183-186 of SEQ ID NO:11; fifteen predicted protein kinase C phosphorylation sites (PS00005) located at about amino acids 34-36, 63-65, 95-97, 126-128, 154-156, 181-183, 487-489, 490-492, 568-570, 580-582, 840-842, 845-847, 883-885, 893-895 and 924-926 of SEQ ID NO:11; eleven predicted casein kinase II phosphorylation sites (PS00006) located at about amino acids 44-47, 63-66, 107-110, 167-170, 278-281, 324-327, 597-600, 646-649, 702-705, 802-805 and 845-848 of SEQ ID NO:11; one predicted tyrosine kinase phosphorylation site (PS00007) located at about amino acid 118-125 of SEQ ID NO:11; eight predicted N-myristoylation sites (PS00008) located at about amino acids 48-53, 122-127, 207-212, 338-343, 381-386, 529-534, 538-543 and 679-684 of SEQ ID NO:11; a predicted amidation site (PS00009) located at about amino acid 126-129 of SEQ ID NO:11; a predicted serine/threonine protein kinase active-site sign (PS00108) located at about amino acid 633-645 of SEQ ID NO:11; and seven dileucine motifs in the tail at about amino acids 442-443, 550-551, 564-565, 691-692, 694-695, 849-850, and 889-890 of SEQ ID NO:11.

In one embodiment, a 16228 family member can include at least one protein kinase domain (PFAM Accession Number PF00069) and at least one or two transmembrane domains. Furthermore, a 16228 family member can include at least one N-glycosylation site (PS00001); at least one cAMP- and cGMP-dependent protein kinase phosphorylation sites (PS00004); at least one, two, three, four, five, six, seven, eight, nine, ten, eleven, twelve, thirteen, fourteen and preferably fifteen protein kinase C phosphorylation sites (PS00005); at least one, two, three, four, five, six, seven, eight, nine, ten, and preferably eleven casein kinase II phosphorylation sites (PS00006); at least one tyrosine kinase phosphorylation site (PS00007); at least one amidation site (PS00009); at least one serine/threonine protein kinase active-site sign (PS00108); and at least one, two, three, four, five, six, and preferably seven dileucine motifs in the tail.

A hydropathy plot of human 16228 reveals the hydrophobic and hydrophilic areas of the molecule. Polypeptides of the invention include fragments which include: all or part of a hydrophobic sequence, e.g., the sequence from about amino acid 200 to 210, from about 300 to 320, and from about 705 to 720 of SEQ ID NO:11; all or part of a hydrophilic sequence, e.g., the sequence from about amino acid 150 to 200, from about 410 to 420, and from about 490 to 510 of SEQ ID NO:11; a sequence which includes a Cys, or a glycosylation site.

A 16228 polypeptide can include at least one or two "transmembrane domains" or regions homologous with a "transmembrane domain". As used herein, the term "transmembrane domain" includes an amino acid sequence of about 10 to 40 amino acid residues in length and spans the plasma membrane. Transmembrane domains are rich in hydrophobic residues, e.g., at least 50%, 60%, 70%, 80%, 90%, 95% or more of the amino acids of a transmembrane domain are hydrophobic, e.g., leucines, isoleucines, tyrosines, or tryptophans. Transmembrane domains typically have alpha-helical structures and are described in, for example, Zagotta, W. N. et al., (1996) *Annual Rev. Neurosci.* 19:235-263, the contents of which are incorporated herein by reference.

In a preferred embodiment, a 16228 polypeptide or protein has at least one or two "transmembrane domains" or regions which include at least about 12 to 35 more preferably about 14 to 30 or 15 to 25 amino acid residues and has at least about 60%, 70% 80% 90% 95%, 99%, or 100% homology with a "transmembrane domain," e.g., the transmembrane domains of human 16228 (e.g., residues 201 to 221 and 433 to 451 of SEQ ID NO:11).

To identify the presence of a "transmembrane" domain in a 16228 protein sequence, and make the determination that a polypeptide or protein of interest has a particular profile, the amino acid sequence of the protein can be analyzed by a transmembrane prediction method that predicts the secondary structure and topology of integral membrane proteins based on the recognition of topological models (MEMSAT, Jones et al., (1994) Biochemistry 33:3038-3049).

A mature 16228 polypeptide can include at least one, two, preferably three "non-transmembrane regions." As used herein, the term "non-transmembrane region" includes an amino acid sequence not identified as a transmembrane domain. The non-transmembrane regions in 16228 are located at about amino acids 1 to 200 (or 35-200), 222 to 432, and 452 to 926 of SEQ ID NO: 11.

The non-transmembrane regions of 16228 include at least one preferably two cytoplasmic regions. When located at the N-terminus, the cytoplasmic region is referred to herein as the "N-terminal cytoplasmic domain." As used herein, an "N-terminal cytoplasmic domain" includes an amino acid sequence having about 1 to 300, preferably about 1 to 250, more preferably about 1 to 225 or even more preferably about 1 to 200 or 1 to 165 amino acid residues in length and is located inside of a cell or within the cytoplasm of a cell. The C-terminal amino acid residue of an "N-terminal cytoplasmic domain" is adjacent to an N-terminal amino acid residue of a transmembrane domain in a 16228 protein. For example, an N-terminal cytoplasmic domain is located at about amino acid residues 1 to 200 of SEQ ID NO:11.

In a preferred embodiment, a polypeptide or protein has an N-terminal cytoplasmic domain or a region which includes at least about 5, preferably about 1 to 300, and more preferably about 1 to 200 amino acid residues and has at least about 60%, 70% 80% 90% 95%, 99%, or 100% homology with an "N-terminal cytoplasmic domain," e.g., the N-terminal cytoplasmic domain of human 16228 (e.g., residues 1 to 200 of SEQ ID NO:1).

In another embodiment, a cytoplasmic region of a 16228 protein can include the C-terminus and can be a "C-terminal cytoplasmic domain," also referred to herein as a "C-terminal cytoplasmic tail." As used herein, a "C-terminal cytoplasmic domain" includes an amino acid sequence having a length of at least about 10, preferably about 10 to 500, more preferably about 150 to 475 amino acid residues and is located inside of a cell or within the cytoplasm of a cell. The N-terminal amino acid residue of a "C-terminal cytoplasmic domain" is adjacent to a C-terminal amino acid residue of a transmembrane domain in a 16228 protein. For example, a C-terminal cytoplasmic domain is located at about amino acid residues 452 to 926 of SEQ ID NO:11.

In a preferred embodiment, a 16228 polypeptide or protein has a C-terminal cytoplasmic domain or a region which includes at least about 5, preferably about 10 to 200, and more preferably about 150 to 200 amino acid residues and has at least about 60%, 70% 80% 90% 95%, 99%, or 100% homology with a C-terminal cytoplasmic domain," e.g., the C-terminal cytoplasmic domain of human 16228 (e.g., residues 452 to 926 of SEQ ID NO:11).

In another embodiment, a 16228 protein includes at least one non-cytoplasmic loop. As used herein, a "non-cytoplasmic loop" includes an amino acid sequence located outside of a cell or within an intracellular organelle. Non-cytoplasmic loops include extracellular domains (i.e., outside of the cell) and intracellular domains (i.e., within the cell). When referring to membrane-bound proteins found in intracellular organelles (e.g., mitochondria, endoplasmic reticulum, peroxisomes microsomes, vesicles, endosomes, and lysosomes), non-cytoplasmic loops include those domains of the protein that reside in the lumen of the organelle or the matrix or the intermembrane space. For example, a "non-cytoplasmic loop" can be found at about amino acid residues 222 to 432 of SEQ ID NO:11.

In a preferred embodiment, a 16228 polypeptide or protein has at least one non-cytoplasmic loop or a region which includes at least about 4, preferably about 5 to 300, more preferably about 6 to 225 amino acid residues and has at least about 60%, 70% 80% 90% 95%, 99%, or 100% homology with a "non-cytoplasmic loop," e.g., at least one non-cytoplasmic loop of human 16228 (e.g., residues 222 to 432 of SEQ ID NO:11).

A 16228 molecule can further include a signal sequence. The human 16228 protein of SEQ ID NO:11 includes an amino-terminal hydrophobic amino acid sequence, consistent with a signal sequence of about 35 amino acids (from amino acid 1 to about amino acid 35 of SEQ ID NO:11, PSORT, Nakai, K. and Kanehisa, M. (1992) Genomics 14:897-911), which upon cleavage results in the production of a mature protein form.

As used herein, a "signal sequence" refers to a peptide of about 10-80 amino acid residues in length which occurs at the N-terminus of secretory and integral membrane proteins and which contains a majority of hydrophobic amino acid residues. For example, a signal sequence contains at least about 10-50 amino acid residues, preferably about 20-40 amino acid residues, more preferably about 35 amino acid residues, and has at least about 40-70%, preferably about 50-65%, and more preferably about 55-60% hydrophobic amino acid residues (e.g., alanine, valine, leucine, isoleucine, phenylalanine, tyrosine, tryptophan, or proline). Such a "signal sequence", also referred to in the art as a "signal peptide", serves to direct a protein containing such a sequence to a lipid bilayer. For example, in one embodiment, a 16228 protein contains a signal sequence of about amino acids 1-35 of SEQ ID NO:11. The "signal sequence" is cleaved during processing of the mature protein. The mature 16228 protein corresponds to amino acids 35 to 926 of SEQ ID NO:11.

In another embodiment, the isolated proteins of the present invention, preferably 16228 proteins, are identified based on the presence of at least one Ser/Thr kinase site.

Accordingly, another embodiment of the invention features isolated 16228 proteins and polypeptides having a 16228 activity. Preferred proteins are 16228 proteins having at least one Ser/Thr kinase. Additional preferred proteins have at least one Ser/Thr kinase site and preferably a 16228 activity. Additional preferred proteins have at least one Ser/Thr kinase site and are, preferably, encoded by a nucleic acid molecule having a nucleotide sequence which hybridizes under stringent hybridization conditions to a nucleic acid molecule comprising the nucleotide sequence of SEQ ID NO:10 or SEQ ID NO:12. Amino acid residues 633 to 645 of the 16228 protein comprise a Ser/Thr kinase domain.

The nucleic acid encodes a polypeptide with similarities known Ser/Thr kinases. Thus the 16228 encoded polypeptide is expected to be a kinase and function in the phosphorylation of protein substrates. Additionally, the 16228 nucleic acids can be used in known or novel screens and assays for kinase encoding nucleic acids to distinguish it from other distinct nucleic acids. Alternatively, the nucleic acid sequences can be used in the preparation of phylogenetic trees and relationships between organisms.

The 13237, 18480, 2245 or 16228 proteins contain a significant number of structural characteristics in common with members of the protein kinase family. The term "family" when referring to the protein and nucleic acid molecules of the invention means two or more proteins or nucleic acid molecules having a common structural domain or motif and having sufficient amino acid or nucleotide sequence homology as defined herein. Such family members can be naturally or non-naturally occurring and can be from either the same or different species. For example, a family can contain a first protein of human origin as well as other distinct proteins of human origin, or alternatively, can contain homologues of non-human origin, e.g., rat or mouse proteins. Members of a family can also have common functional characteristics.

Kinases play a critical role in the mechanism of intracellular signal transduction. They act on the hydroxyamino acids of target proteins to catalyze the transfer of a high energy phosphate group from adenosine triphosphate (ATP). This process is known as protein phosphorylation. Along with phosphatases, which remove phosphates from phosphorylated proteins, kinases participate in reversible protein phosphorylation. Reversible phosphorylation acts as the main strategy for regulating protein activity in eukaryotic cells.

Protein kinases play critical roles in the regulation of biochemical and morphological changes associated with cell proliferation, differentiation, growth and division (D'Urso, G. et al. (1990) Science 250: 786-791; Birchmeier. C. et al. (1993) Bioessays 15: 185-189). They serve as growth factor receptors and signal transducers and have been implicated in cellular transformation and malignancy (Hunter, T. et al. (1992) Cell 70: 375-387; Posada, J. et al. (1992) Mol. Biol. Cell 3: 583-592; Hunter, T. et al. (1994) Cell 79: 573-582). For example, protein kinases have been shown to participate in the transmission of signals from growth-factor receptors (Sturgill, T. W. et al. (1988) Nature 344: 715-718; Gomez, N. et al. (1991) Nature 353: 170-173), control of entry of cells into mitosis (Nurse, P. (1990) Nature 344: 503-508; Mailer, J. L. (1991) Curr. Opin. Cell Biol. 3: 269-275) and regulation of actin bundling (Husain-Chishti, A. et al. (1988) Nature 334: 718-721).

Kinases vary widely in their selectivity and specificity of target proteins. They still may, however, comprise the largest known enzyme superfamily. Protein kinases can be divided into two main groups based on either amino acid sequence similarity or specificity for either serine/threonine or tyrosine residues. Serine/threonine specific kinases are often referred to as STKs while tyrosine specific kinases are referred to as PTKs. A small number of dual-specificity kinases are structurally like the serine/threonine-specific group. Within the broad classification, kinases can be further sub-divided into families whose members share a higher degree of catalytic domain amino acid sequence identity and also have similar biochemical properties. Most protein kinase family members also share structural features outside the kinase domain that reflect their particular cellular roles. These include regulatory domains that control kinase activity or interaction with other proteins (Hanks, S. K. et al. (1988) Science 241: 42-52).

Almost all kinases contain a catalytic domain composed of 250-300 conserved amino acids. This catalytic domain may be viewed as composed of 11 subdomains. Some of these subdomains apparently contain distinct amino acid motifs which confer specificity as a STK or PTK or both. Kinases may also contain additional amino acid sequences, usually between 5 and 100 residues, flanking or occurring within the catalytic domain. These residues apparently act to regulate kinase activity and to determine substrate specificity. (Reviewed in Hardie, G. and Hanks, S. (1995) The Protein Kinase Facts Book, Vol 1:7-20 Academic Press, San Diego, Calif.)

Approximately one third of the known oncogenes encode PTKs. PTKs may occur as either transmembrane or soluble proteins. Transmembrane PTKs act as receptors for many growth factors. Interaction of a growth factor to its cognate receptor initiates the phosphorylation of specific tyrosine residues in the receptor itself as well as in certain second messenger proteins. Growth factors found to associate with such PTK receptors include epidermal growth factor, platelet-derived growth factor, fibroblast growth factor, hepatocyte growth factor, insulin and insulin-like growth factors, nerve growth factor, vascular endothelial growth factor, and macrophage colony stimulating factor.

Soluble PTKs often interact with the cytosolic domains of plasma membrane receptors. Receptors that signal through such PTKs include cytokine, hormone, and antigen-specific lymphocytic receptors. Many PTks were identified as oncogene products by the observation that PTK activation was no longer subject to normal cellular controls. Also, increased tyrosine phosphorylation activity is often observed in cellular transformation, or oncogenesis, (Carbonneau, H. and Tonks, N. K. (1992) Annu. Rev. Cell Biol. 8:463-93.)

As used herein, the term "protein kinase" includes a protein or polypeptide which is capable of modulating its own phosphorylation state or the phosphorylation state of another protein or polypeptide. Protein kinases can have a specificity for (i.e., a specificity to phosphorylate) serine/threonine residues, tyrosine residues, or both serine/threonine and tyrosine residues, e.g., the dual specificity kinases. As referred to herein, protein kinases preferably include a catalytic domain of about 200-400 amino acid residues in length, preferably about 200-300 amino acid residues in length, or more preferably about 250-300 amino acid residues in length, which includes preferably 5-20, more preferably 5-15, or preferably 11 highly conserved motifs or subdomains separated by sequences of amino acids with reduced or minimal conservation. Specificity of a protein kinase for phosphorylation of either tyrosine or serine/threonine can be predicted by the sequence of two of the subdomains (VIb and VIII) in which different residues are conserved in each class (as described in, for example, Hanks et al. (1988) Science 241:42-52) the contents of which are incorporated herein by reference). These subdomains are also described in further detail herein.

Protein kinases play a role in signaling pathways associated with cellular growth. For example, protein kinases are involved in the regulation of signal transmission from cellular receptors, e.g., growth-factor receptors; entry of cells into mitosis; and the regulation of cytoskeleton function, e.g., actin bundling. Thus, the 13237, 18480, 2245 or 16228 molecules of the present invention may be involved in: 1) the regulation of transmission of signals from cellular receptors, e.g., cell growth factor receptors; 2) the modulation of the entry of cells into mitosis; 3) the modulation of cellular differentiation; 4) the modulation of cell death; and 5) the regulation of cytoskeleton function, e.g., actin bundling.

Inhibition or over stimulation of the activity of protein kinases involved in signaling pathways associated with cellular growth can lead to perturbed cellular growth, which can in turn lead to cellular growth related disorders. As used herein, a "cellular growth related disorder" includes a disorder, disease, or condition characterized by a deregulation, e.g., an upregulation or a downregulation, of cellular growth. Cellular growth deregulation may be due to a deregulation of cellular proliferation, cell cycle progression, cellular differentiation and/or cellular hypertrophy.

A 13237, 18480, 2245 or 16228 polypeptide can include a "kinase domain" or regions homologous with an "kinase domain".

As used herein, the term "kinase domain" includes an amino acid sequence of about 10-500 amino acid residues in length and having a bit score for the alignment of the sequence to the kinase domain (HMM) of at least 8. Preferably, a kinase domain includes at least about 20-350 amino acids, more preferably about 25-325 amino acid residues, or about 30-310 amino acids and has a bit score for the alignment of the sequence to the kinase domain (HMM) of at least 16 or greater. The kinase domain (HMM) has been assigned the PFAM Accession PF01553.

In a preferred embodiment 13237, 18480, 2245 or 16228 polypeptide or protein has a "kinase domain" or a region which includes at least about 10-500 more preferably about 20-350 or 30-310 amino acid residues and has at least about 60%, 70%, 80%, 90%, 95%, 99%, or 100% homology with an "kinase domain," e.g., the kinase domain of human 13237, 18480, 2245 or 16228.

To identify the presence of an "kinase" domain in a 13237, 18480, 2245 or 16228 protein sequence, and make the determination that a polypeptide or protein of interest has a particular profile, the amino acid sequence of the protein can be searched against a database of HMMs (e.g., the Pfam database, release 2.1) using the default parameters. For example, the hmmsf program, which is available as part of the HMMER package of search programs, is a family specific default program for MILPAT0063 and a score of 15 is the default threshold score for determining a hit. Alternatively, the threshold score for determining a hit can be lowered (e.g., to 8 bits). A description of the Pfam database can be found in Sonhammer et al., (1997) *Proteins* 28(3):405-420 and a detailed description of HMMs can be found, for example, in Gribskov et al., (1990) *Meth. Enzymol.* 183:146-159; Gribskov et al., (1987) *Proc. Natl. Acad. Sci. USA* 84:4355-4358; Krogh et al., (1994) *J. Mol. Biol.* 235:1501-1531; and Stultz et al., (1993) *Protein Sci.* 2:305-314, the contents of which are incorporated herein by reference. A search was performed against the HMM database resulting in the identification of a "kinase" domain in the amino acid sequence of human 13237 at about residues 385-418 and 906-1056 of SEQ ID NO:2 (the identified Pfam kinase domain consensus amino acid sequence of human 13237 corresponds to SEQ ID NO:13 and 14); of human 18480 at about residues 4 to 258 of SEQ ID NO:5 (the identified Pfam kinase domain consensus amino acid sequence of human 18480 corresponds to SEQ ID NO:17); of human 2245 at about residues 93 to 414 of SEQ ID NO:8 (the identified Pfam kinase domain consensus amino acid sequence of human 2245 corresponds to SEQ ID NO:27); or of human 16228 at about residues 520-781 of SEQ ID NO:11 (the identified Pfam kinase domain consensus amino acid sequence of human 16228 corresponds to SEQ ID NO:31).

For further identification of domains in a 13237, 18480, 2245 or 16228 protein sequence, and make the determination that a polypeptide or protein of interest has a particular profile, the amino acid sequence of the protein can be searched against a database of domains, e.g., the ProDom database (Corpet et al. (1999), *Nucl. Acids Res.* 27:263-267). The ProDom protein domain database consists of an automatic compilation of homologous domains. Current versions of ProDom are built using recursive PSI-BLAST searches (Altschul S F et al. (1997) *Nucleic Acids Res.* 25:3389-3402; Gouzy et al. (1999) 23:333-340) of the SWISS-PROT 38 and TREMBL protein databases. The database automatically generates a consensus sequence for each domain. A BLAST search was performed against the HMM database resulting in the identification of a "kinase ribosomal S6" domain(s) in the amino acid sequence of human 13237 at about residues 708 to 908 of SEQ ID NO:2 and 598 to 707 of SEQ ID NO:2 having 92% and 100% identity over those residues respectively (the identified ProDom kinase ribosomal S6 domain consensus amino acid sequences of human 13237 correspond to SEQ ID NO:15 and 16). A BLAST search was performed against the HMM database resulting in the identification of a "regulator factor chromosome condensation repeat of guanine-nucleotide releasing cell cycle" domain(s) in the amino acid sequence of human 18480 at about residues 396 to 479, 560 to 658, 500 to 597, 445 to 540, 618 to 690, and 325 to 437 (six local alignments) of SEQ ID NO:5 having 50%, 36%, 34%, 35%, 30% and 27% identity over those residues respectively (the identified "regulator factor chromosome condensation repeat of guanine-nucleotide releasing cell cycle" domain consensus amino acid sequences of human 18480 correspond to SEQ ID NO:18, 19, 20, 21, 22 and 23). A BLAST search was performed against the HMM database resulting in the identification of a "kinase cell mitosis serine/threonine-protein cycle 2.7.1-phosphorylation division nuclear G2-specific" domain(s) in the amino acid sequence of human 18480 at about residues 2 to 120 of SEQ ID NO:5 having 34% identity over those residues (the identified "kinase cell mitosis serine/threonine-protein cycle 2.7.1-phosphorylation division nuclear G2-specific" domain consensus amino acid sequence of human 18480 corresponds to SEQ ID NO:24); A BLAST search was performed against the HMM database resulting in the identification of a "kinase serine/threonine-protein Y39G8B.5III R107.4 chromosome ATP-binding transferase 2.7.1" domain(s) in the amino acid sequence of human 18480 at about residues 2 to 174 and 182 to 204 of SEQ ID NO:5 (two local alignments) having 28% and 47% identity over those residues respectively (the identified "kinase serine/threonine-protein Y39G8B.5III R107.4 chromosome ATP-b in d in g transferase 2.7.1" domain consensus amino acid sequences of human 18480 correspond to SEQ ID NO:25 and 26). A BLAST search was performed against the HMM database resulting in the identification of a "kinase serine/threonine-protein transferase receptor ATP-binding 2.7.1 tyrosine-protein phosphorylation precursor" domain(s) in the amino acid sequence of human 2245 at about residues 234 to 410, 242 to 409, and 93 to 218 (three local alignments) of SEQ ID NO:8 (the identified "kinase serine/threonine-protein transferase receptor ATP-binding 2.7.1 tyrosine-protein phosphorylation precursor" domain consensus amino acid sequences of human 2245 correspond to SEQ ID NO:28, 29 and 30). A BLAST search was performed against the HMM database resulting in the identification of a "kinase serine/threonine-protein C41C4.4 IRE1 II precursor kinase/endoribonuclease chromosome ATP-binding CG4583" domain(s) in the amino acid sequence of human 16228 at about residues 37 to 144 and 153 to 374 (two local alignments) of SEQ ID NO:11 (the identified "kinase serine/threonine-protein C41C4.4 IRE1 II precursor kinase/endoribonuclease chromosome ATP-binding CG4583" domain consensus amino acid sequences of human 16228 correspond to SEQ ID NO:32 and 33). A BLAST search was performed against the HMM database resulting in the identification of a "IRE1" domain(s) in the amino acid sequence of human 16228 at about residues 3 to 130 (one local alignment) of SEQ ID NO:11 (the identified "IRE1" domain consensus amino acid sequence of human 16228 corresponds to SEQ ID NO:34). Finally, a BLAST search was performed against the HMM database resulting in the identification of a "kinase serine/threonine-protein precursor transferase signal ATP-binding transmembrane 2.7.1,-IRE1 glycoprotein" domain(s) in the amino acid sequence of human 16228 at about residues 798 to 910 and 782 to 863 (two local alignments) of SEQ ID NO:11 (the identified "kinase serine/threonine-protein precursor transferase signal ATP-binding transmembrane 2.7.1,-IRE1 glycoprotein" domain consensus amino acid sequences of human 16228 correspond to SEQ ID NO:35 and 36).

As the 13237, 18480, 2245 or 16228 polypeptides of the invention may modulate 13237-, 18480-, 2245- or 16228-mediated activities, they may be useful for developing novel diagnostic and therapeutic agents for 13237-, 18480-, 2245- or 16228-mediated or related disorders, as described below.

As used herein, a "13237, 18480, 2245 or 16228 activity", "biological activity of 13237, 18480, 2245 or 16228" or "functional activity of 13237, 18480, 2245 or 16228", refers to an activity exerted by a 13237, 18480, 2245 or 16228 protein, polypeptide or nucleic acid molecule on e.g., a 13237-, 18480-, 2245- or 16228-responsive cell or on a 13237, 18480, 2245 or 16228 substrate, e.g., a lipid or protein substrate, as determined in vivo or in vitro. In one embodiment, a 13237, 18480, 2245 or 16228 activity is a direct activity, such as an association with a 13237, 18480, 2245 or 16228 target molecule. A "target molecule" or "binding partner" is a molecule with which a 13237, 18480, 2245 or 16228 protein binds or interacts in nature, e.g., a protein to which the 13237, 18480, 2245 or 16228 protein attaches a phosphate. A 13237, 18480, 2245 or 16228 activity can also be an indirect activity, e.g., a cellular signaling activity mediated by interaction of the 13237, 18480, 2245 or 16228 protein with a 13237, 18480, 2245 or 16228 ligand.

Polypeptides of the invention include those which arise as a result of the existence of multiple genes, alternative transcription events, alternative RNA splicing events, and alternative translational and postranslational events. The polypeptide can be expressed in systems, e.g., cultured cells, which result in substantially the same postranslational modifications present when expressed the polypeptide is expressed in a native cell, or in systems which result in the alteration or omission of postranslational modifications, e.g., gylcosylation or cleavage, present when expressed in a native cell.

In a preferred embodiment, a 13237, 18480, 2245 or 16228 polypeptide has one or more of the following characteristics: it has the ability to reversibly phosphorylate proteins in order to regulate protein activity in eukaryotic cells; it has a molecular weight, e.g., a deduced molecular weight, amino acid composition or other physical characteristic of the polypeptide of SEQ ID NO:2, SEQ ID NO:5, SEQ ID NO:8 or SEQ ID NO:11; it has an overall sequence similarity of at least 50%, preferably at least 60%, more preferably at least 70, 80, 90, or 95%, with a polypeptide of SEQ ID NO:2, SEQ ID NO:5, SEQ ID NO:8 or SEQ ID NO:11; it has an protein kinase domain which preferably has an overall sequence similarity of about 70%, 80%, 90% or 95% with SEQ ID NO:2, SEQ ID NO:5, SEQ ID NO:8 or SEQ ID NO:11; and it has at least 70%, preferably 80%, and most preferably 95% of the cysteines found in the amino acid sequence of the native protein.

Gene Expression Analysis of 13237, 18480, 2245 and 16228

Total RNA was prepared from various human tissues by a single step extraction method using RNA STAT-60 according to the manufacturer's instructions (TelTest, Inc). Each RNA preparation was treated with DNase I (Ambion) at 37° C. for 1 hour. DNAse I treatment was determined to be complete if the sample required at least 38 PCR amplification cycles to reach a threshold level of fluorescence using 0-2 microglobulin as an internal amplicon reference. The integrity of the RNA samples following DNase I treatment was confirmed by agarose gel electrophoresis and ethidium bromide staining. After phenol extraction cDNA was prepared from the sample using the SUPERSCRIPT™ Choice System following the manufacturer's instructions (GibcoBRL). A negative control of RNA without reverse transcriptase was mock reverse transcribed for each RNA sample.

Human 13237, 18480, 2245 or 16228 expression was measured by TaqMan® quantitative PCR (Perkin Elmer Applied Biosystems) in cDNA prepared from a variety of normal and diseased (e.g., cancerous) human tissues or cell lines.

Probes were designed by PrimerExpress software (PE Biosystems) based on the sequence of the human 13237, 18480, 2245 or 16228 gene. Each human 13237, 18480, 2245 or 16228 gene probe was labeled using FAM (6-carboxyfluorescein), and the β2-microglobulin reference probe was labeled with a different fluorescent dye, VIC. The differential labeling of the target gene and internal reference gene thus enabled measurement in same well. Forward and reverse primers and the probes for both β2-microglobulin and target gene were added to the TaqMan® Universal PCR Master Mix (PE Applied Biosystems). Although the final concentration of primer and probe could vary, each was internally consistent within a given experiment. A typical experiment contained 200 nM of forward and reverse primers plus 100 nM probe for β-2 microglobulin and 600 nM forward and reverse primers plus 200 nM probe for the target gene. TaqMan® matrix experiments were carried out on an ABI PRISM 7700 Sequence Detection System (PE Applied Biosystems). The thermal cycler conditions were as follows: hold for 2 min at 50° C. and 10 min at 95° C., followed by two-step PCR for 40 cycles of 95° C. for 15 sec followed by 60° C. for 1 min.

The following method was used to quantitatively calculate human 13237, 18480, 2245 or 16228 gene expression in the various tissues relative to β-2 microglobulin expression in the same tissue. The threshold cycle (Ct) value is defined as the cycle at which a statistically significant increase in fluorescence is detected. A lower Ct value is indicative of a higher mRNA concentration. The Ct value of the human 13237, 18480, 2245 or 16228 gene is normalized by subtracting the Ct value of the β-2 microglobulin gene to obtain a ΔCt value using the following formula: $\Delta Ct = Ct_{human\ 59914\ and\ 59921} - Ct_{\beta-2\ microglobulin}$. Expression is then calibrated against a cDNA sample showing a comparatively low level of expression of the human 13237, 18480, 2245 or 16228 gene. The ΔCt value for the calibrator sample is then subtracted from ΔCt for each tissue sample according to the following formula: $\Delta\Delta Ct = \Delta Ct_{sample} - \Delta Ct_{calibrator}$. Relative expression is then calculated using the arithmetic formula given by 2-ΔΔCt. Expression of the target human 13237, 18480, 2245 or 16228 gene in each of the tissues tested is then graphically represented as discussed in more detail below.

TaqMan® real-time quantitative RT-PCR is used to detect the presence of RNA transcript corresponding to human 13237 relative to a no template control in a panel of human tissues or cells. It is found that the highest expression of 13237 orthologs are expressed in normal brain cortex as shown in the following Table 2.

TABLE 2

Phase 1.5.2 Expression of 13237

| Tissue Type | Mean | β 2 Mean | ∂∂ Ct | Expression |
|---|---|---|---|---|
| Artery normal | 30.26 | 22.31 | 7.28 | 6.4343 |
| Aorta diseased | 33.23 | 22.52 | 10.05 | 0.9433 |
| Vein normal | 29.9 | 20.41 | 8.81 | 2.2203 |
| Coronary SMC | 29.18 | 23.27 | 5.24 | 26.4608 |
| HUVEC | 26.7 | 21.69 | 4.34 | 49.3776 |
| Hemangioma | 29 | 20.11 | 8.21 | 3.3771 |
| Heart normal | 28.5 | 20.61 | 7.22 | 6.7075 |
| Heart CHF | 27.61 | 19.98 | 6.96 | 8.0321 |
| Kidney | 29.34 | 20.37 | 8.3 | 3.1619 |
| Skeletal Muscle | 29.31 | 22.88 | 5.76 | 18.453 |
| Adipose normal | 31.47 | 20.88 | 9.91 | 1.0358 |
| Pancreas | 29.03 | 22 | 6.36 | 12.1744 |
| primary osteoblasts | 29.65 | 20.86 | 8.12 | 3.607 |
| Osteoclasts (diff) | 33.3 | 17.75 | 14.88 | 0.0332 |
| Skin normal | 31.71 | 22.19 | 8.85 | 2.1671 |
| Spinal cord normal | 29.92 | 21.12 | 8.13 | 3.5697 |
| Brain Cortex normal | 26.11 | 22.23 | 3.2 | 108.8188 |
| Brain Hypothalamus normal | 27.5 | 22.1 | 4.74 | 37.5511 |
| Nerve | 31.02 | 22.11 | 8.23 | 3.3306 |
| DRG (Dorsal Root Ganglion) | 27.78 | 22.18 | 4.93 | 32.8036 |
| Breast normal | 29.92 | 21.25 | 8 | 3.9198 |
| Breast tumor | 29.38 | 21.09 | 7.63 | 5.0658 |
| Ovary normal | 26.58 | 20.44 | 5.47 | 22.5614 |
| Ovary Tumor | 30.39 | 20.36 | 9.35 | 1.5324 |
| Prostate Normal | 27.63 | 20.13 | 6.83 | 8.7895 |
| Prostate Tumor | 26.06 | 20.51 | 4.88 | 34.0784 |
| Salivary glands | 29.54 | 19.74 | 9.13 | 1.7848 |
| Colon normal | 27.98 | 18.64 | 8.67 | 2.4551 |

TABLE 2-continued

Phase 1.5.2 Expression of 13237

| Tissue Type | Mean | β 2 Mean | ∂∂ Ct | Expression |
|---|---|---|---|---|
| Colon Tumor | 26.22 | 19.32 | 6.22 | 13.4151 |
| Lung normal | 27.8 | 17.98 | 9.15 | 1.7603 |
| Lung tumor | 25.64 | 20.42 | 4.55 | 42.6888 |
| Lung COPD | 28.29 | 18.5 | 9.11 | 1.8097 |
| Colon IBD | 26.93 | 17.85 | 8.41 | 2.9399 |
| Liver normal | 29.52 | 20.27 | 8.58 | 2.6131 |
| Liver fibrosis | 29.91 | 21.85 | 7.39 | 5.9413 |
| Spleen normal | 30.87 | 20.06 | 10.15 | 0.8832 |
| Tonsil normal | 28.09 | 17.35 | 10.07 | 0.9335 |
| Lymph node normal | 29.28 | 19.34 | 9.27 | 1.6198 |
| Small intestine normal | 31.49 | 20.64 | 10.18 | 0.862 |
| Skin-Decubitus | 29.37 | 21.29 | 7.41 | 5.8799 |
| Synovium | 31.6 | 20.15 | 10.78 | 0.5687 |
| BM-MNC | 30.98 | 19.13 | 11.19 | 0.4295 |
| Activated PBMC | 30.59 | 17.9 | 12.02 | 0.2408 |
| Neutrophils | 30.05 | 19.2 | 10.18 | 0.865 |
| Megakaryocytes | 26.8 | 18.94 | 7.18 | 6.8723 |
| Erythroid | 27.86 | 21.69 | 5.5 | 22.1738 |

TaqMan® real-time quantitative RT-PCR is used to detect the presence of RNA transcript corresponding to human 18480 relative to a no template control in a panel of human tissues or cells. It is found that the highest expression of 18480 orthologs are expressed in HUVEC as shown in the following Table 3.

TABLE 3

Phase 1.5.2 Expression of 18480

| Tissue Type | Mean | β 2 Mean | ∂∂ Ct | Expression |
|---|---|---|---|---|
| Artery normal | 34.26 | 23.27 | 10.99 | 0.4917 |
| Aorta diseased | 32.16 | 22.72 | 9.44 | 1.4397 |
| Vein normal | 35.98 | 20.28 | 15.7 | 0 |
| Coronary SMC | 33.06 | 23.07 | 9.98 | 0.9868 |
| HUVEC | 27.28 | 22.07 | 5.21 | 26.9233 |
| Hemangioma | 29.09 | 20.11 | 8.97 | 1.9873 |
| Heart normal | 31.45 | 20.93 | 10.53 | 0.6787 |
| Heart CHF | 31.4 | 20.02 | 11.39 | 0.3739 |
| Kidney | 26.52 | 20.7 | 5.82 | 17.7628 |
| Skeletal Muscle | 33.1 | 23.08 | 10.03 | 0.9598 |
| Adipose normal | 35.04 | 21.09 | 13.95 | 0 |
| Pancreas | 29.88 | 21.98 | 7.91 | 4.1721 |
| primary osteoblasts | 33.88 | 21.05 | 12.84 | 0.1369 |
| Osteoclasts (diff) | 34.31 | 17.9 | 16.41 | 0.0114 |
| Skin normal | 31.06 | 21.95 | 9.1 | 1.8223 |
| Spinal cord normal | 34.17 | 21.14 | 13.03 | 0.1196 |
| Brain Cortex normal | 30.76 | 22.25 | 8.51 | 2.7431 |
| Brain Hypothalamus normal | 30.31 | 22.2 | 8.11 | 3.6321 |
| Nerve | 35.23 | 22.4 | 12.84 | 0 |
| DRG (Dorsal Root Ganglion) | 31.22 | 22.25 | 8.96 | 2.0011 |
| Breast normal | 30.93 | 21.04 | 9.88 | 1.0576 |
| Breast tumor | 31.63 | 21.29 | 10.34 | 0.7715 |
| Ovary normal | 28.89 | 20.61 | 8.27 | 3.2395 |
| Ovary Tumor | 29.23 | 20.68 | 8.55 | 2.6588 |
| Prostate Normal | 28.4 | 20.13 | 8.27 | 3.2395 |
| Prostate Tumor | 28.95 | 20.78 | 8.16 | 3.4841 |
| Salivary glands | 32.22 | 19.95 | 12.27 | 0.2032 |
| Colon normal | 30.91 | 18.66 | 12.25 | 0.2053 |
| Colon Tumor | 27.34 | 19.31 | 8.03 | 3.8391 |
| Lung normal | 29.87 | 18.49 | 11.38 | 0.3752 |
| Lung tumor | 26.93 | 20.66 | 6.27 | 12.9581 |
| Lung COPD | 28.62 | 18.75 | 9.87 | 1.0686 |
| Colon IBD | 30.18 | 17.99 | 12.2 | 0.2133 |
| Liver normal | 30.22 | 20.32 | 9.9 | 1.043 |
| Liver fibrosis | 30.48 | 22.11 | 8.38 | 3.0121 |
| Spleen normal | 28.82 | 20.19 | 8.63 | 2.5329 |
| Tonsil normal | 26.12 | 17.67 | 8.45 | 2.8595 |
| Lymph node normal | 28.45 | 19.48 | 8.97 | 1.9873 |
| Small intestine normal | 34.67 | 20.89 | 13.78 | 0.0711 |
| Skin-Decubitus | 34.37 | 21.63 | 12.74 | 0.1457 |

TABLE 3-continued

Phase 1.5.2 Expression of 18480

| Tissue Type | Mean | β 2 Mean | ∂∂ Ct | Expression |
|---|---|---|---|---|
| Synovium | 30.85 | 20.01 | 10.84 | 0.5456 |
| BM-MNC | 35.14 | 19.09 | 16.05 | 0 |
| Activated PBMC | 32.8 | 18.17 | 14.63 | 0.0396 |
| Neutrophils | 32.72 | 19.48 | 13.23 | 0.1037 |
| Megakaryocytes | 30.06 | 19.19 | 10.87 | 0.5343 |
| Erythroid | 29.23 | 21.63 | 7.6 | 5.1543 |

TaqMan® real-time quantitative RT-PCR is used to detect the presence of RNA transcript corresponding to human 2245 relative to a no template control in a panel of human tissues or cells. It is found that the highest expression of 2245 orthologs are expressed in normal brain cortex and HUVEC as shown in the following Table 4.

TABLE 4

Phase 1.6.3 Expression of 2245

| Tissue Type | Mean | β 2 Mean | ∂∂ Ct | Expression |
|---|---|---|---|---|
| Artery normal | 29.64 | 24.14 | 5.17 | 27.8728 |
| Aorta diseased | 31 | 24.32 | 6.34 | 12.3444 |
| Vein normal | 31.13 | 22.47 | 8.32 | 3.1184 |
| Coronary SMC | 27.66 | 23.58 | 3.74 | 74.8424 |
| HUVEC | 26.58 | 23.97 | 2.27 | 206.6126 |
| Hemangioma | 28.41 | 22.22 | 5.84 | 17.3972 |
| Heart normal | 28.33 | 22.18 | 5.8 | 17.8863 |
| Heart CHF | 27.65 | 21.53 | 5.78 | 18.199 |
| Kidney | 28.5 | 22.36 | 5.79 | 18.0733 |
| Skeletal Muscle | 36.81 | 30.26 | 6.21 | 0 |
| Adipose normal | 30.84 | 23.7 | 6.79 | 9.0054 |
| Pancreas | 29.98 | 24.73 | 4.91 | 33.377 |
| primary osteoblasts | 30.16 | 22.39 | 7.43 | 5.7789 |
| Osteoclasts (diff) | 28.86 | 19.32 | 9.19 | 1.7121 |
| Skin normal | 30.64 | 24.36 | 5.93 | 16.4018 |
| Spinal cord normal | 29.99 | 23.34 | 6.31 | 12.6038 |
| Brain Cortex normal | 27.43 | 24.8 | 2.29 | 205.1854 |
| Brain Hypothalamus normal | 29.59 | 24.86 | 4.38 | 47.8612 |
| Nerve | 30.9 | 23.82 | 6.74 | 9.3878 |
| DRG (Dorsal Root Ganglion) | 31.26 | 24.06 | 6.87 | 8.5789 |
| Breast normal | 29.48 | 23.46 | 5.67 | 19.5729 |
| Breast tumor | 29.63 | 23.38 | 5.91 | 16.6308 |
| Ovary normal | 28.3 | 22.33 | 5.63 | 20.193 |
| Ovary Tumor | 30.93 | 22.45 | 8.14 | 3.5327 |
| Prostate Normal | 29.15 | 21.41 | 7.39 | 5.9413 |
| Prostate Tumor | 27.96 | 22.36 | 5.25 | 26.1871 |
| Salivary glands | 29.48 | 21.98 | 7.15 | 7.041 |
| Colon normal | 29.13 | 21.12 | 7.67 | 4.9273 |
| Colon Tumor | 28.21 | 24.18 | 3.69 | 77.2137 |
| Lung normal | 29.18 | 20.76 | 8.09 | 3.6828 |
| Lung tumor | 26.34 | 22.11 | 3.88 | 67.9209 |
| Lung COPD | 28.5 | 20.55 | 7.62 | 5.0834 |
| Colon IBD | 29.23 | 19.84 | 9.05 | 1.8801 |
| Liver normal | 30.41 | 22.62 | 7.46 | 5.6993 |
| Liver fibrosis | 29.49 | 23.63 | 5.52 | 21.7929 |
| Spleen normal | 31.15 | 22.36 | 8.45 | 2.8595 |
| Tonsil normal | 27.22 | 19.05 | 7.83 | 4.3948 |
| Lymph node normal | 29.22 | 21.6 | 7.28 | 6.4343 |
| Small intestine normal | 30.73 | 22.84 | 7.55 | 5.3361 |
| Macrophages | 28.55 | 19.41 | 8.79 | 2.2592 |
| Synovium | 31.52 | 22.32 | 8.86 | 2.1522 |
| BM-MNC | 30.03 | 21.23 | 8.46 | 2.8398 |
| Activated PBMC | 28.89 | 19.5 | 9.05 | 1.8866 |
| Neutrophils | 28.57 | 20.87 | 7.37 | 6.0662 |
| Megakaryocytes | 27.04 | 20.98 | 5.71 | 19.0377 |
| Erythroid | 27.42 | 24.07 | 3.01 | 124.1366 |
| positive control | 24.89 | 22.75 | 1.8 | 287.1746 |

TaqMan® expression data of 2245 in an angiogenesis panel shows significant expression in Wilm's tumor and fetal adrenal cells as shown in the following Table 5.

TABLE 5

| Tissue Type | Mean 2245a | β 2 Mean | ∂∂ Ct | Expression |
|---|---|---|---|---|
| ONC 101 Hemangioma | 33.19 | 18.81 | 14.39 | 0.05 |
| ONC 102 Hemangioma | 27.45 | 18.26 | 9.2 | 1.71 |
| ONC 103 Hemangioma | 26.59 | 19.82 | 6.77 | 9.16 |
| NDR 203 Normal Kidney | 27.98 | 20.26 | 7.71 | 4.76 |
| PIT 213 Renal Cell Carcinoma | 32.35 | 20.13 | 12.22 | 0.21 |
| CHT 732 Wilms Tumor | 24.68 | 19.59 | 5.09 | 29.26 |
| CHT 765 Wilms Tumor | 26.86 | 22.72 | 4.14 | 56.52 |
| NDR 295 Skin | 30.75 | 23.36 | 7.39 | 5.96 |
| CHT 1424 Uterine Adenocarcinoma | 26.01 | 18.34 | 7.67 | 4.91 |
| CHT 1238 Neuroblastoma | 25.31 | 19.14 | 6.17 | 13.89 |
| BWH 78 Fetal Adrenal | 24.05 | 18.96 | 5.09 | 29.46 |
| BWH 74 Fetal Kidney | 25.34 | 20.41 | 4.92 | 33.03 |
| BWH 4 Fetal Heart | 25.1 | 18.41 | 6.69 | 9.69 |
| MPI 849 Normal Heart | 26.3 | 19.93 | 6.38 | 12.05 |
| NDR 764 Cartilage | 32.18 | 24.13 | 8.05 | 3.77 |
| CLN 746 Spinal cord | 28.66 | 20.86 | 7.81 | 4.46 |
| CHT 1753 lymphangiona | 33.08 | 24.29 | 8.79 | 2.27 |
| NEB 3 Synovium (RA) | 33.8 | 22.43 | 11.37 | 0.38 |
| CLN 1221 Hyperkeratotic skin | 30.44 | 23.57 | 6.87 | 8.55 |
| CLN 944 Endometrial polyps | 33.56 | 26.18 | 7.38 | 6.00 |
| CHT 1273 Glioblastoma | 24.59 | 20 | 4.6 | 41.23 |
| CHT 216 Glioblastoma | 27.34 | 18.3 | 9.04 | 1.90 |
| CHT 501 Glioblastoma | 27.05 | 20.2 | 6.84 | 8.73 |

TaqMan® expression data of 2245 in an oncology phase II plate shows highest expression in breast and lung tumor as shown in the following Table 6. Upregulation of 2245 is shown in 5/5 breast tumor samples, 7/7 lung tumor samples, 4/4 colon tumor samples and 2/2 colon metastases. Positive expression is shown in normal ovarian and ovarian tumors.

TABLE 6

| Tissue Type | Mean 2245a | β 2 Mean | ∂∂ Ct | Expression |
|---|---|---|---|---|
| PIT 400 Breast N | 31.6 | 20.32 | 11.28 | 0.40 |
| PIT 372 Breast N | 33.5 | 20.61 | 12.9 | 0.13 |
| CHT 558 Breast N | 31.21 | 20.05 | 11.16 | 0.44 |
| CLN 168 Breast T: IDC | 29.02 | 21.18 | 7.84 | 4.36 |
| MDA 304 Breast T: MD-IDC | 28.9 | 19.09 | 9.8 | 1.12 |
| NDR 58 Breast T: IDC | 27.55 | 18 | 9.55 | 1.33 |
| NDR 05 Breast T: IDC | 25.29 | 21.02 | 4.26 | 52.01 |
| CHT 562 Breast T: IDC | 26.11 | 19.03 | 7.08 | 7.39 |
| NDR 12 Breast T | 28.98 | 22.93 | 6.05 | 15.09 |
| PIT 208 Ovary N | 26.78 | 19.86 | 6.92 | 8.29 |
| CHT 620 Ovary N | 28.73 | 20.4 | 8.34 | 3.10 |
| CLN 03 Ovary T | 28.34 | 20.08 | 8.26 | 3.26 |
| CLN 17 Ovary T | 27.75 | 20.75 | 6.99 | 7.87 |
| MDA 25 Ovary T | 29.03 | 22.57 | 6.46 | 11.36 |
| MDA 216 Ovary T | 31.79 | 22.36 | 9.43 | 1.45 |
| CLN 012 Ovary T | 29.33 | 23.06 | 6.27 | 12.96 |
| MDA 185 Lung N | 31.92 | 22.48 | 9.44 | 1.44 |
| CLN 930 Lung N | 30.57 | 20.21 | 10.37 | 0.76 |
| MDA 183 Lung N | 29.52 | 18.36 | 11.16 | 0.44 |
| MPI 215 Lung T--SmC | 24.52 | 19.68 | 4.85 | 34.67 |
| MDA 259 Lung T-PDNSCCL | 25.25 | 20.73 | 4.53 | 43.43 |
| CHT 832 Lung T-PDNSCCL | 28.15 | 20.07 | 8.09 | 3.68 |
| MDA 253 Lung T-PDNSCCL | 26.66 | 19.34 | 7.32 | 6.26 |
| MDA 262 Lung T-SCC | 28.04 | 22.37 | 5.67 | 19.64 |

TABLE 6-continued

| Tissue Type | Mean 2245a | β 2 Mean | ∂∂ Ct | Expression |
|---|---|---|---|---|
| CHT 211 Lung T-AC | 27.64 | 19.92 | 7.71 | 4.76 |
| CHT 793 Lung T-ACA | 25.57 | 18.8 | 6.78 | 9.13 |
| CHT 396 Colon N | 30.99 | 19.38 | 11.62 | 0.32 |
| CHT 523 Colon N | 29.58 | 20.28 | 9.3 | 1.59 |
| CHT 452 Colon N | 30.2 | 17.57 | 12.64 | 0.16 |
| CHT 382 Colon T: MD | 27.27 | 18.25 | 9.02 | 1.93 |
| CHT 528 Colon T: MD | 26.81 | 18.41 | 8.39 | 2.98 |
| CLN 609 Colon T | 26.18 | 19.7 | 6.49 | 11.16 |
| CHT 372 Colon T: MD-PD | 28.82 | 20.39 | 8.43 | 2.90 |
| CHT 340 Colon-Liver Met | 27.41 | 21.27 | 6.15 | 14.08 |
| NDR 100 Colon-Liver Met | 26.16 | 18.71 | 7.46 | 5.70 |
| PIT 260 Liver N (female) | 29.38 | 17.61 | 11.77 | 0.29 |
| ONC 102 Hemangioma | 30.06 | 20.17 | 9.89 | 1.05 |
| A24 HMVEC-Arr | 27.23 | 20.7 | 6.53 | 10.82 |
| C48 HMVEC-Prol | 26.32 | 20.63 | 5.69 | 19.37 |
| NHBE | 25.68 | 22.13 | 3.55 | 85.38 |

TaqMan® expression data of 16228 in an oncology phase plate I shows highest expression in ovarian tumors and significant expression in lung tumor as shown in the following Table 7. Upregulation of 16228 is shown in 8/8 ovary tumor samples and 6/8 lung tumor samples. Low expression is found in normal breast and breast tumors.

TABLE 7

| | Average 16228.2 | Average Beta-2 | Relative Expression |
|---|---|---|---|
| Breast N | 36.5 | 21.9 | 0.04 |
| Breast N | 37.2 | 20.1 | 0.01 |
| Breast T | 34.3 | 17.7 | 0.01 |
| Breast T | 36.5 | 17.5 | 0.00 |
| Breast T | 33.8 | 18.5 | 0.03 |
| Breast T | 34.2 | 17.1 | 0.01 |
| Breast T | 35.5 | 20.6 | 0.03 |
| Breast T | 36.5 | 19.2 | 0.01 |
| Breast T | 34.1 | 20.4 | 0.08 |
| Ovary N | 36.4 | 18.4 | 0.00 |
| Ovary N | 36.0 | 19.0 | 0.01 |
| Ovary N | 40.0 | 23.4 | 0.00 |
| Ovary T | 32.5 | 19.3 | 0.10 |
| Ovary T | 26.0 | 18.6 | 5.74 |
| Ovary T | 31.6 | 19.2 | 0.18 |
| Ovary T | 30.2 | 18.7 | 0.34 |
| Ovary T | 29.7 | 18.0 | 0.30 |
| Ovary T | 33.1 | 20.2 | 0.13 |
| Ovary T | 34.4 | 20.9 | 0.09 |
| Ovary T | 32.3 | 17.0 | 0.02 |
| Lung N | 32.1 | 17.4 | 0.04 |
| Lung N | 33.7 | 19.9 | 0.07 |
| Lung N | 31.3 | 16.9 | 0.05 |
| Lung N | 29.7 | 16.6 | 0.12 |
| Lung T | 29.2 | 16.5 | 0.15 |
| Lung T | 28.6 | 17.0 | 0.32 |
| Lung T | 30.1 | 18.7 | 0.39 |
| Lung T | 33.7 | 17.3 | 0.01 |
| Lung T | 31.1 | 19.6 | 0.35 |
| Lung T | 28.1 | 19.5 | 2.53 |
| Lung T | 31.3 | 18.7 | 0.16 |
| Lung T | 33.8 | 17.6 | 0.01 |

TaqMan expression data of 16228 in an oncology phase plate II shows highest expression in normal colon and high positive expression in colon tumor as shown in the following Table 8. Upregulation of 16228 is shown in 3/4 liver metastases. Low or no expression is found in normal breast and breast tumors, HUVEC, placenta, fetal adrenal and fetal liver.

TABLE 8

|  | Average 16228.2 | Average Beta 2 | Relative Expression |
|---|---|---|---|
| Colon N | 21.5 | 16.4 | 61.6 |
| Colon N | 24.3 | 20.7 | 170.8 |
| Colon N | 23.1 | 18.0 | 58.7 |
| Colon N | 22.7 | 16.5 | 28.4 |
| Colon T | 22.1 | 16.2 | 35.5 |
| Colon T | 21.7 | 17.0 | 80.2 |
| Colon T | 22.6 | 15.8 | 18.4 |
| Colon T | 22.6 | 16.8 | 39.0 |
| Colon T | 21.3 | 16.2 | 60.6 |
| Colon T | 27.3 | 23.1 | 116.2 |
| Colon T | 22.0 | 15.8 | 28.7 |
| Liver Met | 21.7 | 17.2 | 90.6 |
| Liver Met | 25.7 | 19.4 | 26.7 |
| Liver Met | 28.6 | 17.3 | 0.8 |
| Liver Met | 26.2 | 17.2 | 4.1 |
| Liver Nor | 28.9 | 17.1 | 0.6 |
| Liver Nor | 38.1 | 22.5 | 0.0 |
| Brain N | 35.2 | 19.2 | 0.0 |
| Brain N | 32.5 | 19.8 | 0.3 |
| Brain N | 33.2 | 20.0 | 0.2 |
| Brain N | 32.9 | 19.3 | 0.2 |
| Brain T | 34.2 | 18.0 | 0.0 |
| Brain T | 33.2 | 16.6 | 0.0 |
| Brain T | 33.8 | 17.1 | 0.0 |
| Brain T | 34.2 | 17.1 | 0.0 |
| Brain T | 33.7 | 16.8 | 0.0 |
| Brain T | 37.4 | 18.5 | 0.0 |
| HMVEC | 32.4 | 16.0 | 0.0 |
| HMVEC | 32.6 | 16.8 | 0.0 |
| Placenta | 35.3 | 16.0 | 0.0 |
| Fetal Adrenal | 30.9 | 23.1 | 9.2 |
| Fetal Adrenal | 34.8 | 23.0 | 0.6 |
| Fetal Liver | 33.0 | 19.2 | 0.1 |
| Fetal Liver | 33.2 | 17.8 | 0.0 |

In Situ Hybridization Results for 2245

The in situ hybridization results shown below in Table 9 show increased numbers of positive cells evident in tumors of the breast, colon, lung, ovary, kidney (Wilm's) over that found in the normals. Significant expression was also detected in the angiogenic tissues, Wilm's tumors and fetal adrenal over that found in the normals. Clearly, the greater percentage of expressing cells found in tumors by ISH support the differential expression found by TaqMan® analyses.

A notable increase was shown in the percent positive cells in breast tumors (4/4) versus normal breast cells (1/2). Lung tumors often exhibited increased positive cells (3/3) over normal lung cells (2/3). Elevated numbers of expressing cells were found in some colon cells: 2/2/colon tumor cells, 2/3 colon metastases versus 1/3 normal colon cells. All ovarian tumors (3/3) were positive for expression of 2245 versus normal stroma (0/1).

TABLE 9

| Spectrum # | Tissue | Diagnosis | Results |
|---|---|---|---|
| ANGIOGENIC TISSUES: 2/5 | | | |
| CHT 734 | Kidney | Wilm's Tumor | (+/−) |
| BWH 36 | Adrenal | Normal: Fetal | (++) |
| CLN 1221 | Skin | Decubitus | (−) |
| TCH 1 | Skin | Hemangioma | (−) |
| TCH 5 | Skin | Hemangioma | (−) |
| BREAST: 1/2 normals; 4/4 tumors | | | |
| Notable increases in % of positive cells in all tumors. | | | |
| NDR 825 | Breast | Normal | (−) |
| CHT 2248 | Breast | Normal | (+/−) |

TABLE 9-continued

| Spectrum # | Tissue | Diagnosis | Results |
|---|---|---|---|
| MDA 156 | Breast | Tumor: DCIS/IDC | (+) |
| CHT 1782 | Breast | Tumor: IDC | (++) |
| CLN 662 | Breast | Tumor: IDC/ILC | (+/−) |
| CLN 658 | Breast | Tumor: ILC | (+/−) |
| LUNG: 2/3 normals; 3/3 tumors | | | |
| 2/3 tumors exhibited a greater number of positive cells. | | | |
| CHT 688 | Lung | Normal | (−) |
| CHT 689 | Lung | Normal | (+/−) |
| CHT 446* | Lung | Normal | (+/−) |
| CHT 846 | Lung | Tumor: SCC | (+) |
| CHT 446* | Lung | Tumor: WD/MD-AC | (+/−) |
| MPI 323 | Lung | Tumor: Small Cell | (+) |
| OVARY: 0/1 normal stroma; 3/3 tumors | | | |
| MDA 201 | Ovary | Normal stroma | (−) |
| MDA 23 | Ovary | Tumor: MD-PS | (+/−) |
| MDA 19 | Ovary | Tumor: PD-PS | (+) |
| MDA 21 | Ovary | Tumor: PD-PS | (+) |
| COLON: 1/3 normals; 2/2 tumors; 2/3 metastases | | | |
| Increased percentage of labeled cells in 2/4 malignancies. | | | |
| CHT 840 | Colon | Normal | (+/−) |
| PIT 337 | Colon | Normal | (−) |
| CHT 1866* | Colon | Normal | (−) |
| CHT 1866* | Colon | Hyperplasia/dysplasia | (+/−) |
| CHT 1855 | Colon | Primary Tumor | (−) |
| CHT 1792 | Colon | Primary Tumor | (+) |
| NDR 77 | Colon | Metastasis: Colon to Liver | (+) |
| CHT 77 | Colon | Metastasis: Colon to Liver | (−) |
| CHT 849 | Colon | Metastasis: Colon to Liver | (+/−) |

*asterisk indicates that both normal and malignant components exist in the specimen and these were evaluated separately.

Accordingly, 13237, 18480, 2245 or 16228 proteins may mediate various disorders, including cellular proliferative and/or differentiative disorders, breast disorders, colon disorders, lung disorders, ovarian disorders, kidney disorders, brain disorders, heart disorders, blood vessel disorders, and platelet disorders.

Human 7677

The human 7677 sequence (SEQ ID NO:39), which is approximately 2745 nucleotides long including untranslated regions, contains a predicted methionine-initiated coding sequence of about 1995 nucleotides (nucleotides 270-2267 of SEQ ID NO:39; nucleotides 1-1995 of SEQ ID NO:41), not including the terminal codon. The coding sequence encodes a 665 amino acid protein (SEQ ID NO:40).

This mature protein form is approximately 665 amino acid residues in length (from about amino acid 1 to amino acid 665 of SEQ ID NO:40). Human 7677 contains a predicted transmembrane domain which extends from about amino acid residue 385-401 of SEQ ID NO:40.

The 7677 protein contains a significant number of structural characteristics in common with members of the ATPase family. The term "family" when referring to the protein and nucleic acid molecules of the invention means two or more proteins or nucleic acid molecules having a common structural domain or motif and having sufficient amino acid or nucleotide sequence homology as defined herein. Such family members can be naturally or non-naturally occurring and can be from either the same or different species. For example, a family can contain a first protein of human origin as well as other distinct proteins of human origin, or alternatively, can contain homologues of non-human origin, e.g., rat or mouse proteins.

Enzymes that bind to and hydrolyze ATP play a pivotal role in translating chemically stored energy into biological activity. Proteins that bind and hydrolyze ATP are frequently involved in the early steps of DNA replication. ATPases can function in a variety of cellular processes including, selective ion transport events, actin-based motility, membrane traffic and numerous biosynthetic pathways. Multiple ATPase families exist, including ion pumps, DEAD box-helicases, ABC transporters, and AAA (ATPases Associated to a variety of cellular Activities).

The AAA family of ATPases is characterized by a highly conserved AAA motif. This motif forms a 230 AA domain that imparts ATPase activity. Members of this class have 1 or 2 domains.

AAA proteins play essential roles in cellular housekeeping, cell division and differentiation and have been identified in prokaryotes and eukaryotes. All members of the AAA family are $Mg^{2+}$ dependent ATPases and comprise a conserved region that binds ATP. Cytosolic, transmembrane, as well as, membrane-associated AAA family members have been identified in various cellular locations and multimeric states.

The biological role of the AAA family members in the cell is diverse. Currently, members of this ATPase family are known to be involved in organelle biogenesis, cell-cycle regulation, vesicle-mediated transport and biogenesis, assembly of proteins through membranes, peroxisome biogenesis, gene expression in yeast and in human, and 26S proteasome function. For a review, see Confalonieri et al. (1995) *BioEssays* 17:639-650. AAA-family members also include metalloproteases. See also Patel, S. et al. (1998) *Trends Cell Biol* 8(2) 65-71.

Several members of the AAA family are involved in the biogenesis of peroxisomes. These organelles contain enzymes responsible for fatty acid oxidation and the elimination of peroxides. AAA family members, such as the PAS genes of *S. cerevisiae*, appear to be required for peroxisome growth, and proliferation (Subramani et al. (1993) *Annu. Rev. Cell Biol.* 9:445-478). Furthermore, mutations in the AAA proteins Pex1p or Pex6p accumulate abnormal peroxisomal vesicles, suggesting a defect in vesicle fusion during peroxisome assembly (Song et al. (1993) *J. Cell Biol.* 123:535-548 and Heyman et al. (1994) *J. Cell Biol.* 127:1269-1273).

AAA family members are also known to regulate transcription. Nelbock et al. described the TBP1 protein that binds human HIV TAT transactivator, thus impairing its activity in cotransfection experiments (Nelbock et al. (1990) *Science* 248: 1650-1653). TBP1 has since been identified as an AAA family member that acts as a transcriptional activator for various promoters (Ohana et al. (1993) *Proc. Natl. Acad. Scie.* 90:138-142).

The AAA family of ATPase is thought of as a class of molecular chaperones that assist in the noncovalent assembly of other proteins or protein complexes. Thus, the AAA family members play critical regulatory roles in the assembly or regulation of various molecular machines associated with diverse cellular activities.

The present invention is based, at least in part, on the discovery of novel molecules, referred to herein as "ATPase" or "7677" nucleic acid and polypeptide molecules, which play a role in or function in the conversion of chemical energy into biological energy. In one embodiment, the 7677 molecules modulate the activity of one or more proteins involved in cellular housekeeping processes, such as cell division and differentiation. In another embodiment, the 7677 molecules of the present invention are capable of modulating actin-based motility mechanisms. In yet another embodiment, the 7677 molecules of the present invention are involved in the functioning of selective ion transportation through membranes.

As assessed by TaqMan® analysis, the 7677 nucleic acid was found to be expressed in cells of the fetal heart, brain, breast, colon, fetal liver, as well as epithelial cells, aortic smooth muscle cells (SMC) and HUVEC cells in particular. Therefore, the encoded protein ATPase is at least expected to catalyze cell type specific ATPase-related reactions in those cells.

Comparison of the 7677 nucleic acids of SEQ ID NO:39 to various databases reveal that 7677 partially aligns with several other human expressed sequence tag (EST) cDNA sequences. The aligned EST-cDNA sequences recently reported in DBEST (DBEST accession nos. AW241815, AA621580, AI040917, AW957342, and BE019356) do not have annotations that associate the ESTs with the area of oncology. However, the EST-cDNA sequence accession no. AW241815 has been reported as similar to hypothetical *H. influenzae* hypothetical protein P45262, which in turn was annotated as an ATP-binding protein.

Another EST-cDNA sequence (GenBank accession no. U56249) aligned with approximately 20% of the C-terminus of 7677 and was reported as human HELA mRNA isolated as a false positive during two-hybrid screening. Another EST-cDNA sequence (Patent DB accession no. T25215) aligned with approximately 60 nucleotides of the 3' end and parts of the non-translated region with an 87% identity and was reported as identifying gene signatures in 3'-directed human cDNA-library, e.g. for diagnosis of abnormal cell function.

As illustrated above, the 7677 molecules of the invention have upregulated expression in various tumors versus normal tissues. In addition, further TaqMan® analyses revealed that the 7677 molecules of the invention have been found to be cell cycle regulated in several different tumor cell lines. Important pathways involved in tumorgenesis include protein degradation via the proteasome, DNA damage repair and cell cycle regulation. As such, without being bound by theory, the 7677 molecules of the invention may play a role in regulating aspects of one or more of these pathways.

The 7677 protein of the invention has homology to RuvB DNA helicase. A partial protein, a putative helicase, that is identical in part to the 7677 protein has been reported as being similar to *E. coli* RuvB helicase. (Adamson et al, (2000) locus AF218313 accession AAF80563). Moreover, a rat RuvB-like protein, TIP49a, also shows significant homology to bacterial RuvB helicase (Makino et al, (1999) *Journal of Biol Chem* 274(22):15329-35). It has been reported that TIP49a may play a role in nuclear processes such as recombination and transcription. As such, the 7677 protein of the invention may also play a role in such in nuclear processes.

Stimulation of 7677 activity is desirable in situations in which 7677 is abnormally downregulated and/or in which increased 7677 activity is likely to have a beneficial effect. Likewise, inhibition of 7677 activity is desirable in situations in which 7677 is abnormally upregulated and/or in which decreased 7677 activity is likely to have a beneficial effect.

Inhibition or over stimulation of the activity of ATPases can lead to cellular growth related disorders. As used herein, a "cellular growth related disorder" includes a disorder, disease, or condition characterized by a deregulation, e.g., an upregulation or a downregulation, of cellular growth. Cellular growth deregulation may be due to a deregulation of cellular proliferation, cell cycle progression, cellular differentiation and/or cellular hypertrophy. Examples of cellular growth related disorders include cardiovascular disorders such as heart failure, hypertension, atrial fibrillation, dilated cardiomyopathy, idiopathic cardiomyopathy, or angina; proliferative disorders or differentiative disorders such as cancer, e.g., melanoma, prostate cancer, cervical cancer, breast cancer, colon cancer, or sarcoma.

As used herein, the term "ATPase" includes a protein or polypeptide which is capable of translating chemical energy into biological energy.

The 7677 protein also includes the following domains: three N-glycosylation sites (PS00001) located at about amino acids 334-337, 415-418 and 516-519 of SEQ ID NO:40; one glycosaminoglycan attachment site (PS00002) located at about amino acids 203-206 of SEQ ID NO:40; four cAMP- and cGMP-dependent protein kinase phosphorylation sites (PS00004) located at about amino acids 72-75, 136-139, 286-289 and 320-323 of SEQ ID NO:40; nine predicted protein kinase C phosphorylation sites (PS00005) located at about amino acids 54-56, 139-141, 153-155, 230-232, 285-287, 289-291, 403-405, 456-458 and 509-511 of SEQ ID NO:40; eleven predicted casein kinase II phosphorylation sites (PS00006) located at about amino 4-7, 34-37, 87-90, 92-95, 156-159, 235-238, 254-257, 336-339, 416-419, 436-439 and 477-480 of SEQ ID NO:40; three predicted tyrosine kinase phosphorylation sites (PS00007) located at about amino acids 427-434, 494-500 and 624-631 of SEQ ID NO:40; eight predicted N-myristoylation sites (PS00008) located at about amino acids 53-58, 201-206, 241-246, 271-276, 446-451, 484-489, 512-517 and 569-574 of SEQ ID NO:40; two predicted amidation sites (PS00009) located at about amino acids 134-137 and 139-142 of SEQ ID NO:40; one ATP/GTP-binding site motif A (PS00017) located at about amino acids 268-275 of SEQ ID NO:40; and one leucine zipper pattern (PS00029) located at about amino acids 604-625 of SEQ ID NO:40.

The ATPase-like protein of the invention possesses a NB-ARC domain, which is a signaling motif of cell death regulators, from aa 266-278 of SEQ ID NO:40, AAA domains from aa 263-459 and 260-380 of SEQ ID NO:40, an adenylate kinase domain from aa 266-274 of SEQ ID NO:40, and an ultradead 3 domain from aa 206-383 of SEQ ID NO:40, as predicted by HMMer, Version 2. The NB-ARC domain is a novel signaling motif shared by plant resistant gene products and regulators of cell death in animals. See for example, Van der Biezen et al. (1998) *Curr Biol* 8:229-227. Adenylate kinase is a small monomeric enzyme that catalyzes the reversible transfer of MgATP to AMP. In mammals there are three different isozymes: AK1 (or myokinase), which is cytosolic; AK2, which is located in the outer compartment of mitochondria; and, AK3 (or GTP:AMP phosphotransferase), which is located in the mitochondrial matrix and which uses MgGTP instead of MgATP. The RNA helices domain is found in a family of RNA helices thought to be involved in duplex unwinding during viral RNA replication. Members of this family are found in a variety of single stranded RNA viruses. See for example, Gorbalenya et al. (1989) *NAR* 17:4713-4730. The AAA domain (ATPase Associated with various cellular Activities) is found in a family of proteins that often perform chaperone-like functions that assist in the assembly, operation, or disassembly of protein complexes. See for example, Confalonieri et al. (1995) *Bioessays* 17:639-650 and Neuwald et al. (1999) *Genome Research* 9:27-43.

For general information regarding PFAM identifiers, PS prefix and PF prefix domain identification numbers, refer to Sonnhammer et al. (1997) *Protein* 28:405-420.

The 7677 protein contains a significant number of structural characteristics in common with members of the ATPase family. The term "family" when referring to the protein and nucleic acid molecules of the invention means two or more proteins or nucleic acid molecules having a common structural domain or motif and having sufficient amino acid or nucleotide sequence homology as defined herein. Such family members can be naturally or non-naturally occurring and can be from either the same or different species. For example, a family can contain a first protein of human origin as well as other distinct proteins of human origin, or alternatively, can contain homologues of non-human origin, e.g., rat or mouse proteins. Members of a family can also have common functional characteristics.

A novel human ATPase-like gene sequence, referred to as 7677, is provided. This gene sequence and variants and fragments thereof are encompassed by the term "ATPase-like" molecules or sequences as used herein. The ATPase-like sequences find use in modulating a ATPase function. By "modulating" is intended the upregulating or downregulating of a response. The sequences of the invention find use in modulating organelle biogenesis, cell-cycle regulation, protein degradation, vesicle-mediated transport, assembly of proteins through membranes, peroxisome biogenesis, gene expression, and 26S proteasome function response. That is, the compositions of the invention, affect the targeted activity in either a positive or negative fashion.

Proteins and/or antibodies of the invention are also useful in modulating the above mentioned cellular process.

The present invention provides isolated nucleic acid molecules comprising nucleotide sequences encoding the ATPase-like polypeptides whose amino acid sequences are given in SEQ ID NO:40, or a variant or fragment of the polypeptides. Nucleotide sequences encoding the ATPase-like polypeptides of the invention are set forth in SEQ ID NO:39.

As used herein, the term "ATPase domain" includes an amino acid sequence of about 50-300 amino acid residues in length and having a bit score for the alignment of the sequence to the ATPase domain (HMM) of at least 50. Preferably, an ATPase domain includes at least about 75-200 amino acids, more preferably about 100-200 amino acid residues, or about 150-200 amino acids and has a bit score for the alignment of the sequence to the ATPase domain (HMM) of at least 60 or greater. The ATPase domain, AAA (ATPases associated with various cellular activities) (HMM) has been assigned the PFAM Accession PF00004.

In a preferred embodiment 7677 polypeptide or protein has a "ATPase domain" or a region which includes at least about 75-150 more preferably about 100-140 or 125-135 amino acid residues and has at least about 60%, 70%, 80%, 90%, 95%, 99%, or 100% homology with an "ATPase domain," e.g., the ATPase domain of human 7677 (e.g., amino acid residues 260-380 of SEQ ID NO:40).

To identify the presence of an "ATPase" domain in a 7677 protein sequence, and make the determination that a polypeptide or protein of interest has a particular profile, the amino acid sequence of the protein can be searched against a database of HMMs (e.g., the Pfam database, release 2.1) using the default parameters. For example, the hmmsf program, which is available as part of the HMMER package of search programs, is a family specific default program for MELPAT0063 and a score of 15 is the default threshold score for determining a hit. Alternatively, the threshold score for determining a hit can be lowered (e.g., to 8 bits). A description of the Pfam database can be found in Sonhammer et al., (1997) *Proteins* 28(3):405-420 and a detailed description of HMMs can be found, for example, in Gribskov et al., (1990) *Meth. Enzymol.* 183:146-159; Gribskov et al., (1987) *Proc. Natl. Acad. Sci. USA* 84:4355-4358; Krogh et al., (1994) *J. Mol. Biol.* 235:

1501-1531; and Stultz et al., (1993) *Protein Sci.* 2:305-314, the contents of which are incorporated herein by reference.

A search was performed against the HMM database resulting in the identification of a "NBC Arc" domain in the amino acid sequence of human 7677 at about residues 266-278 of SEQ ID NO:40 (the identified Pfam "NBC Arc" domain consensus amino acid sequence of human 7677 corresponds to SEQ ID NO:42); of a "AAA" domain in the amino acid sequence of human 7677 at about residues 263-459 of SEQ ID NO:40 (the identified Pfam "AAA" domain consensus amino acid sequence of human 7677 corresponds to SEQ ID NO:43); of a "AAA_5" domain in the amino acid sequence of human 7677 at about residues 260-380 of SEQ ID NO:40 (the identified Pfam "AAA_5" domain consensus amino acid sequence of human 7677 corresponds to SEQ ID NO:44); and of a "UltraDead3" domain in the amino acid sequence of human 7677 at about residues 206-383 of SEQ ID NO:40 (the identified Pfam "UltraDead3" domain consensus amino acid sequence of human 7677 corresponds to SEQ ID NO:45).

For further identification of domains in a 7677 protein sequence, and make the determination that a polypeptide or protein of interest has a particular profile, the amino acid sequence of the protein can be searched against a database of domains, e.g., the ProDom database (Corpet et al. (1999), Nucl. Acids Res. 27:263-267). The ProDom protein domain database consists of an automatic compilation of homologous domains. Current versions of ProDom are built using recursive PSI-BLAST searches (Altschul S F et al. (1997) *Nucleic Acids Res.* 25:3389-3402; Gouzy et al. (1999) 23:333-340) of the SWISS-PROT 38 and TREMBL protein databases. The database automatically generates a consensus sequence for each domain. A BLAST search was performed against the HMM database resulting in the identification of a "Protein ATP binding intergenic region ATP-dependent protease LA homolog hydrolase serine ATP-binding" domain(s) in the amino acid sequence of human 7677 at about residues 216 to 364 and 337 to 450 of SEQ ID NO:40 having 57% and 46% identity over those residues respectively (the identified ProDom "Protein ATP binding intergenic region ATP-dependent protease LA homolog hydrolase serine ATP-binding" domain consensus amino acid sequences of human 7677 correspond to SEQ ID NO:46 and 47). A BLAST search was performed against the HMM database resulting in the identification of a "Protein ATP binding intergenic region C26H5.02C chromosome I ALG9-RAP1 YRVN CY9C4.09" domain in the amino acid sequence of human 7677 at about residues 614 to 661 of SEQ ID NO:40 having 60% identity over those residues (the identified ProDom "Protein ATP binding intergenic region C26H5.02C chromosome I ALG9-RAP1 YRVN CY9C4.09" domain consensus amino acid sequences of human 7677 correspond to SEQ ID NO:48). A BLAST search was performed against the HMM database resulting in the identification of a "Helicase Holliday junction DNA RUVB repair SOS response ATP-binding recombination" domain in the amino acid sequence of human 7677 at about residues 264 to 334 of SEQ ID NO:40 having 40% identity over those residues (the identified ProDom "Helicase Holliday junction DNA RUVB repair SOS response ATP-binding recombination" domain consensus amino acid sequences of human 7677 correspond to SEQ ID NO:49). A BLAST search was performed against the HMM database resulting in the identification of a "ATP-dependent protease LA homolog EC 3.4.21 Hydrolase serine ATP-binding" domain(s) in the amino acid sequence of human 7677 at about residues 216 to 304 and 324 to 364 of SEQ ID NO:40 having 31% and 29% identity over those residues respectively (the identified ProDom "ATP-dependent protease LA homolog EC 3.4.21 Hydrolase serine ATP-binding" domain consensus amino acid sequences of human 7677 correspond to SEQ ID NO:50 and 51). A BLAST search was performed against the HMM database resulting in the identification of a "Protein putative plasmid ATP-binding insertion sequence element transposable transposase ORFB" domain in the amino acid sequence of human 7677 at about residues 211 to 278 of SEQ ID NO:40 having 36% identity over those residues (the identified ProDom "Protein putative plasmid ATP-binding insertion sequence element transposable transposase ORFB" domain consensus amino acid sequences of human 7677 correspond to SEQ ID NO:52). A BLAST search was performed against the HMM database resulting in the identification of a "Serine/threonine kinase putative" domain in the amino acid sequence of human 7677 at about residues 286 to 394 of SEQ ID NO:40 having 26% identity over those residues (the identified ProDom "Serine/threonine kinase putative" domain consensus amino acid sequences of human 7677 correspond to SEQ ID NO:53).

In one embodiment, a 7677 protein includes at least one transmembrane domain. As used herein, the term "transmembrane domain" includes an amino acid sequence of about 15 amino acid residues in length that spans a phospholipid membrane. More preferably, a transmembrane domain includes about at least 18, 20, 22, 24, 25, 30, 35 or 40 amino acid residues and spans a phospholipid membrane. Transmembrane domains are rich in hydrophobic residues, and typically have an α-helical structure. In a preferred embodiment, at least 50%, 60%, 70%, 80%, 90%, 95% or more of the amino acids of a transmembrane domain are hydrophobic, e.g., leucines, isoleucines, tyrosines, or tryptophans. Transmembrane domains are described in, for example Zagotta W. N. et al., (1996) *Annual Rev. Neuronsci.* 19: 235-63, the contents of which are incorporated herein by reference.

In a preferred embodiment, a 7677 polypeptide or protein has at least one transmembrane domain or a region which includes at least 18, 20, 22, 24, 25, 30, 35 or 40 amino acid residues and has at least about 60%, 70% 80% 90% 95%, 99%, or 100% homology with a "transmembrane domain," e.g., at least one transmembrane domain of human 7677 (e.g., amino acid residues 304-328 of SEQ ID NO:40).

In another embodiment, a 7677 protein includes at least one "non-transmembrane domain." As used herein, "non-transmembrane domains" are domains that reside outside of the membrane. When referring to plasma membranes, non-transmembrane domains include extracellular domains (i.e., outside of the cell) and intracellular domains (i.e., within the cell). When referring to membrane-bound proteins found in intracellular organelles (e.g., mitochondria, endoplasmic reticulum, peroxisomes and microsomes), non-transmembrane domains include those domains of the protein that reside in the cytosol (i.e., the cytoplasm), the lumen of the organelle, or the matrix or the intermembrane space (the latter two relate specifically to mitochondria organelles). The C-terminal amino acid residue of a non-transmembrane domain is adjacent to an N-terminal amino acid residue of a transmembrane domain in a naturally-occurring 7677, or 7677-like protein.

In a preferred embodiment, a 7677 polypeptide or protein has a "non-transmembrane domain" or a region which includes at least about 1-500, preferably about 200-450, more preferably about 225-400, and even more preferably about 250-350 amino acid residues, and has at least about 41, 60%, 70% 80% 90% 95%, 99% or 100% homology with a "non-transmembrane domain", e.g., a non-transmembrane domain of human 7677 (e.g., residues 1-384 and 402-665 of SEQ ID NO:40). Preferably, a non-transmembrane domain is capable of catalytic activity (e.g., catalyzing an acylation reaction).

A non-transmembrane domain located at the N-terminus of a 7677 protein or polypeptide is referred to herein as an "N-terminal non-transmembrane domain." As used herein, an "N-terminal non-transmembrane domain" includes an amino acid sequence having about 1-450, preferably about 30-425, more preferably about 50-400, or even more preferably about 80-375 amino acid residues in length and is located outside the boundaries of a membrane. For example, an N-terminal non-transmembrane domain is located at about amino acid residues 1-384 of SEQ ID NO:40.

Similarly, a non-transmembrane domain located at the C-terminus of a 7677 protein or polypeptide is referred to herein as a "C-terminal non-transmembrane domain." As used herein, an "C-terminal non-transmembrane domain" includes an amino acid sequence having about 1-450, preferably about 15-400, preferably about 20-350, more preferably about 25-300 amino acid residues in length and is located outside the boundaries of a membrane. For example, an C-terminal non-transmembrane domain is located at about amino acid residues 402-665 of SEQ ID NO:40.

As the 7677 polypeptides of the invention may modulate 7677-mediated activities, they may be useful for developing novel diagnostic and therapeutic agents for 7677-mediated or related disorders, as described below.

As used herein, a "7677 activity", "biological activity of 7677" or "functional activity of 7677", refers to an activity exerted by a 7677 protein, polypeptide or nucleic acid molecule on e.g., a 7677-responsive cell or on a 7677 substrate, e.g., a lipid or protein substrate, as determined in vivo or in vitro. In one embodiment, a 7677 activity is a direct activity, such as an association with a 7677 target molecule. A "target molecule" or "binding partner" is a molecule with which a 7677 protein binds or interacts in nature, e.g. A 7677 activity can be a direct activity, such as an association with or an enzymatic activity on a second protein, or an indirect activity, such as a cellular signaling activity mediated by interaction of the ATPase-like protein with a second protein.

In a preferred embodiment, an ATPase-like activity includes at least one or more of the following activities: (1) modulating (stimulating and/or enhancing or inhibiting) cellular division; (2) modulating organelle biogenesis; (3) modulating protein sorting; (4) modulating gene expression; (5) modulating protein degradation; and (6) modulating the function of the 26S proteosome.

In a preferred embodiment, a 7677 polypeptide has one or more of the following characteristics: it binds to and hydrolyzes ATP, playing a pivotal role in translating chemically stored energy into biological energy; it has a molecular weight, e.g., a deduced molecular weight, amino acid composition or other physical characteristic of the polypeptide of SEQ ID NO:40; it has an overall sequence similarity of at least 50%, preferably at least 60%, more preferably at least 70, 80, 90, or 95%, with a polypeptide of SEQ ID NO:40; it has an ATPase domain which preferably has an overall sequence similarity of about 70%, 80%, 90% or 95% with amino acid residues 263-459 or 260-380 of SEQ ID NO:40; and it has at least 70%, preferably 80%, and most preferably 95% of the cysteines found in the amino acid sequence of the native protein.

Gene Expression Analysis of 7677

Total RNA was prepared from various human tissues by a single step extraction method using RNA STAT-60 according to the manufacturer's instructions (TelTest, Inc). Each RNA preparation was treated with DNase I (Ambion) at 37° C. for 1 hour. DNAse I treatment was determined to be complete if the sample required at least 38 PCR amplification cycles to reach a threshold level of fluorescence using 13-2 microglobulin as an internal amplicon reference. The integrity of the RNA samples following DNase I treatment was confirmed by agarose gel electrophoresis and ethidium bromide staining. After phenol extraction cDNA was prepared from the sample using the SUPERSCRIPT™ Choice System following the manufacturer's instructions (GibcoBRL). A negative control of RNA without reverse transcriptase was mock reverse transcribed for each RNA sample.

Human 7677 expression was measured by TaqMan® quantitative PCR (Perkin Elmer Applied Biosystems) in cDNA prepared from a variety of normal and diseased (e.g., cancerous) human tissues or cell lines. Variable expression was found in all xenograph friendly cell lines tested. Both TaqMan® as well as microarray results show that the cell cycle was regulated in the G0/G1 phase of synchronized cells of the human breast epithelial cell line, MCF-10A.

Relative expression levels of the 7677 was assessed in colon and liver cells using TaqMan® PCR and increased expression was found in 4/6 colon tumor cell lines in comparison to 3/4 normal colon tissue control; and 3/6 lung metastases in comparison to normal lung tissue control. Expression profiling results using in situ hybridization techniques have shown that 7677 mRNA has been detected in human colon, lung, and breast tumors. Moderate to strong expression (5/6) in lung adenocarcinomas and squamous cell carcinomas in comparison to little or no expression (1/3) found in normal lung tissue. All colon tumors (4/4) demonstrated expression which ranged from low to high levels of intensity in comparison to little or no expression (1/3) found in normal colon tissue. Both breast normal (2/2) and tumor (4/4) were weakly positive for expression of which one tumor exhibited very strong hybridization.

As seen by these results, 7677 molecules have been found to be overexpressed in some tumor cells, where the molecules may be inappropriately propagating either cell proliferation or cell survival signals. As such, 7677 molecules may serve as specific and novel identifiers of such tumor cells. Further, inhibitors of the 7677 molecules are also useful for the treatment of cancer, preferably lung cancer, and useful as a diagnostic.

Accordingly, 7677 proteins may mediate various disorders, including cellular proliferative and/or differentiative disorders, colon disorders, breast disorders, lung disorders, brain disorders, heart disorders, blood vessel disorders, and platelet disorders.

Human 26320

The present invention is based, at least in part, on the discovery of novel acetyltransferase family members, referred to herein as "26320" or "Colon Cancer-Related N-Acetyltransferase-1" or "CONAT-1" nucleic acid and protein molecules.

Acetyltransferases are the enzymes that catalyze the acetylation of protein substrates, and as such, are important regulators of a broad range of cellular processes including, but not limited to, gene expression, cellular metabolism (e.g., drug metabolism), neurotransmitter synthesis, intracellular movement (e.g., mitotic spindle and chromosome movement during cell division), and vesicular transport (Darnell, Lodish and Baltimore. *Molecular Cell Biology*, Scientific American Books, Inc., © 1990). For example, the acetylation of histones is an important transcriptional regulatory mechanism, and may be important in long range chromatin structures such as heterochromatin, locus control regions, and chromosome inactivation.

Histone acetylation is ubiquitous, although steady state levels of acetylation vary in between genomic loci, due to the dynamic balance between acetyltransferases and deacetylases. The acetylation of internal conserved amino terminal lysine residues of core histones is associated with transcriptional activation, and acetyltransferase activity is associated with coactivator complexes (Struhl, K. *Genes Develop.* 12:599-606). Transcriptional regulatory proteins, e.g., the TAFII250 subunit of TFIID, have been identified that possess intrinsic histone acetyltransferase activity, thus linking histone acetylation with transcriptional control (Mizzen, C. A. et al. (1996) *Cell* 87:1261-70). This provides a mechanism by which histone acetyltransferase activity is targeted to promoters in order for the transcriptional machinery to gain access to transcriptionally repressed chromatin. Histone acetylation affects intrinsic chromatin structure and promotes access of the transcriptional machinery to cognate binding sites on DNA (Struhl, K. *Genes Develop.* 12:599-606).

In addition, transcriptional regulatory proteins such as TAFII250, PCAF (p300/CBP-associated factor), and p300/CBP are also capable of acetylating non-histone proteins, such as the basal transcription machinery for RNA Pol II (Inhof, A. et al. (1997) *Curr. Biol.* 7:689-92), and transcription factors such as p53, suggesting that acetylation may also be used as a general mechanism to regulate protein activity within transcription complexes.

N-acetyltransferases catalyze the transfer of acetyl groups from Coenzyme A to the N-termini of most eukaryotic proteins. Two N-acetyltransferases have been isolated from the yeast *Saccharomyces cerevisiae*, namely NAT1 and ARD1, and have been shown to encode the major N alpha-N-acetyltransferase, which acts on certain proteins having serine, glycine, and alanine amino termini but not methionine amino termini. A third gene from *S. cerevisiae*, NAT2, is believed to act on proteins having methionine termini. In humans, two genes, NAT1 and NAT2, have been identified having N-acetyltransferase activity (Kulkarni, M. S. et al. (1994) *J. Biol. Chem.* 269:13141-13147, Blum, M. et al. (1990) *Cell Biol.* 9:193-203).

N-acetyltransferases are essential for the activation and deactivation of aromatic and heterocyclic amine carcinogens. Heterocyclic amines may be colorectal carcinogens. They also participate in the detoxification of hydrazine and arylamine drugs and are able to bioactivate several known carcinogens.

Predisposition for colorectal cancer is connected to hereditary factors and genetic sensitivity to environmental carcinogens. In recent years the polymorphism of genes encoding drug-metabolizing enzymes has been shown to be important. Several studies have shown a role for NAT1 and NAT2 acetylation polymorphisms in cancer risk in human populations. Studies suggest that the NAT1 and NAT2 acetylation polymorphisms modify risk of developing urinary bladder, colorectal, breast, head and neck, lung, and possibly prostate cancers. Associations between rapid NAT2 acetylator genotypes and colorectal cancer are the most consistently reported (Minchin R. F. et al. (1993) *Mutant Res.* 290:35-42, Hein, D. W. et al. (2000) *Toxicol. Lett.* 15:112-113; 349-356).

Several allelic variants of NAT1 and NAT2 have been detected. It is thought that some of them modify individual susceptibility to cancer. For example, slow NAT2 acetylation capacity is linked with decreased risk of colon cancer while increased NAT1 activity is associated with increased risk of bladder and colon cancer (Hirvonen A. (Publ. 1999) in Polymorphic NATs and cancer predisposition, IARC Sci. Publ. 148:251-270, Potter, J. D. (1999) in Colorectal cancer: molecules and population, Natl. Cancer Inst. 91:916-932).

The nucleotide sequence encoding human CONAT-1 polypeptide is set forth as SEQ ID NO:54. The CONAT-1 polypeptide encoded by this nucleic acid comprises about 139 amino acids and has the amino acid sequence set forth as SEQ ID NO:55. CONAT-1 coding region sequences of SEQ ID NO:54 are set forth as SEQ ID NO:56. A second CONAT-1 polypeptide potentially encoded by this nucleic acid comprises about 268 amino acids and has the amino acid sequence set forth as SEQ ID NO:57 with coding region sequences set forth as SEQ ID NO:58. Clone Fbh26320 comprising the human CONAT-1 cDNA was deposited with the American Type Culture Collection (ATCC®), 10801 University Boulevard, Manassas, Va. 20110-2209, on Jun. 7, 2001, and assigned Accession No. PTA-3436.

The term "family" when referring to the protein and nucleic acid molecules of the invention is intended to mean two or more proteins or nucleic acid molecules having a common structural domain or motif and having sufficient amino acid or nucleotide sequence homology as defined herein. Such family members can be naturally or non-naturally occurring and can be from either the same or different species. For example, a family can contain a first protein of human origin as well as other distinct proteins of human origin or alternatively, can contain homologues of non-human origin, e.g., rat or mouse proteins. Members of a family can also have common functional characteristics.

Members of the CONAT-1 family of proteins, for example, include at least one "acetyltransferase domain" in the protein or corresponding nucleic acid molecule. As used herein, the term "acetyltransferase domain" includes a protein domain having at least about 108-158 amino acid residues and has a bit score for the alignment of the sequence to an acetyltransferase (HMM) (e.g., the Pfam acetyltransferase HMM having Accession Number PF00583) of at least 40. More preferably, an acetyltransferase domain includes at least about 128-138, or typically about 131-135 amino acid residues, and has a bit score for the alignment of the sequence to an acetyltransferase (HMM) of at least 45, 50, 55, 60 or greater. A search was performed against the HMM database resulting in the identification of an acetyltransferase domain in the amino acid sequence of human CONAT-1 at about residues 1-116 of SEQ ID NO:55, and in human CONAT-1b at about residues 122-245 of SEQ ID NO:57. Preferably, an acetyltransferase domain has an acetyltransferase activity (e.g., catalyzes the acetylation of a substrate, for example, a protein substrate or target molecule).

A description of the Pfam database can be found in Sonhammer et al. (1997) *Proteins* 28:405-420 and a detailed description of HMMs can be found, for example, in Gribskov et al. (1990) *Meth. Enzymol.* 183:146-159; Gribskov et al. (1987) *Proc. Natl. Acad. Sci. USA* 84:4355-4358; Krogh et al. (1994) *J. Mol. Biol.* 235:1501-1531; and Stultz et al. (1993) *Protein Sci.* 2:305-314, the contents of which are incorporated herein by reference.

To identify the presence of an acetyltransferase domain, and make the determination that a protein of interest has a particular profile, the amino acid sequence of the protein is searched against a database of HMMs (e.g., the Pfam database, release 5.3) using the default parameters. For example, the search can be performed using the hmmsf program (family specific) using the default parameters (e.g., a threshold score of 15) for determining a hit. hmmsf is available as part of the HMMER package of search programs (HMMER 2.1.1, December 1998) which is freely distributed by the Washington University School of Medicine. Alternatively, the threshold score for determining a hit can be lowered (e.g., to 8 bits). A search was performed against the HMM database resulting in the identification of an "acetyltransferase domain" in the amino acid sequence of human CONAT-1 at about residues 1-116 of SEQ ID NO:55, and in human CONAT-1 at about residues 122-245 of SEQ ID NO:57.

The CONAT-1 protein also includes a potential N-glycosylation site at about amino acid residues 103-106 of SEQ ID NO:55; potential protein kinase C phosphorylation sites at about amino acids 20-22 and 102-104 of SEQ ID NO:55; and potential N-myristoylation sites at about amino acids 43-48 and 74-79 of SEQ ID NO:55.

The CONAT-1b protein also includes potential protein kinase C phosphorylation sites from about amino acid residues 102-104, 107-109, 118-120, 149-151, and 231-233 of SEQ ID NO:57; potential casein kinase II phosphorylation sites from about amino acid residues 13-16, 58-61, 79-82, and 107-110 of SEQ ID NO:57; potential N-myristoylation sites from about amino acid residues 26-31, 37-42, 74-79, 172-177, and 203-208 of SEQ ID:NO:57; and a potential N-glycosylation site from about amino acid residues 232-235 of SEQ ID NO:57.

A BLAST search (Altschul et al. (1990) *J. Mol. Biol.* 215:403) of the protein sequences of human CONAT-1 revealed that CONAT-1 is similar to a *Drosophila melanogaster* N-acetyltransferase protein (Accession No. AL022018) having approximately 74% identity over amino acids 3-139 of CONAT-1 (SEQ ID NO:55) and over amino acids 132-268 of CONAT-1b (SEQ ID NO:57) (Identities were calculated using the BLAST algorithms of Altschul et al. (as described herein)).

Additional homologies to other acetyltransferase proteins from *C. elegans, A. thaliana*, and *S. pombe* were identified, as were homologies to the *S. cerevisiae* MAK 3 N-acetyltransferase and the RD 1 N-acetyltransferase complex, ARD1 subunit.

Isolated proteins of the present invention, preferably CONAT-1 proteins, have an amino acid sequence sufficiently homologous to the amino acid sequence of SEQ ID NO:55 or 57, or are encoded by a nucleotide sequence sufficiently homologous to SEQ ID NO:54, 56, or 58. As used herein, the term "sufficiently homologous" refers to a first amino acid or nucleotide sequence which contains a sufficient or minimum number of identical or equivalent (e.g., an amino acid residue which has a similar side chain) amino acid residues or nucleotides to a second amino acid or nucleotide sequence such that the first and second amino acid or nucleotide sequences share common structural domains or motifs and/or a common functional activity. For example, amino acid or nucleotide sequences which share common structural domains having at least 50%, 55%, 60%, 65%, 70%, 75%, 80%, 85%, 85%, 90%, 95%, 96%, 97%, 98%, 99% or more homology or identity across the amino acid sequences of the domains and contain at least one and preferably two structural domains or motifs, are defined herein as sufficiently homologous. Furthermore, amino acid or nucleotide sequences which share at least 50%, 55%, 60%, 65%, 70%, 75%, 80%, 85%, 85%, 90%, 95%, 96%, 97%, 98%, 99% or more homology or identity and share a common functional activity are defined herein as sufficiently homologous.

In a preferred embodiment, a CONAT-1 protein includes at least one acetyltransferase domain, and has an amino acid sequence at least about 50%, 55%, 60%, 65%, 70%, 75%, 80%, 85%, 85%, 90%, 95%, 96%, 97%, 98%, 99% or more homologous or identical to the amino acid sequence of SEQ ID NO:55, or the amino acid sequence encoded by the DNA insert of the plasmid deposited with ATCC as Accession Number PTA-3436. In yet another preferred embodiment, a CONAT-1 protein includes at least one acetyltransferase domain, and is encoded by a nucleic acid molecule having a nucleotide sequence which hybridizes under stringent hybridization conditions to a complement of a nucleic acid molecule comprising the nucleotide sequence of SEQ ID NO:54, SEQ ID NO:56 or SEQ ID NO:58. In another preferred embodiment, a CONAT-1 protein includes at least one acetyltransferase domain, and has a CONAT-1 activity.

As used interchangeably herein, an "CONAT-1 activity", "biological activity of CONAT-1" or "functional activity of CONAT-1", refers to an activity exerted by a CONAT-1 protein, polypeptide or nucleic acid molecule on a CONAT-1 responsive cell or on a CONAT-1 protein substrate, as determined in vivo or in vitro, according to standard techniques. In one embodiment, a CONAT-1 activity is a direct activity, such as an association with a CONAT-1 target molecule. As used herein, a "target molecule" or "binding partner" is a molecule with which a CONAT-1 protein binds or interacts in nature, such that CONAT-1-mediated function is achieved. A CONAT-1 target molecule can be a non-CONAT-1 molecule or a CONAT-1 protein or polypeptide of the present invention. In an exemplary embodiment, a CONAT-1 target molecule is a CONAT-1 substrate or ligand. A CONAT-1 activity can also be an indirect activity, such as a cellular signaling activity mediated by interaction of the CONAT-1 protein with a CONAT-1 substrate or ligand.

In a preferred embodiment, a CONAT-1 activity is at least one of the following activities: (i) interaction with a CONAT-1 substrate or target molecule; (ii) conversion of a CONAT-1 substrate or target molecule to product (e.g., acetylation of the substrate or target molecule); (iii) interaction with and/or modulation of a second non-CONAT-1 protein; (iv) activation/deactivation of CONAT-1 substrates or target molecules (e.g., activation/deactivation of carcinogens, for example heterocyclic and/or aromatic amine carcinogens, e.g., colorectal carcinogens); (v) metabolism and/or detoxification of drugs (e.g., hydrazine and/or arylamine drugs); (vi) modulation of cellular signaling and/or gene transcription (e.g., either directly or indirectly); and (vii) modulation of cellular proliferation and/or differentiation.

Accordingly, another embodiment of the invention features isolated CONAT-1 proteins and polypeptides having a CONAT-1 activity. Preferred proteins are CONAT-1 proteins including at least one acetyltransferase domain, and, preferably, having a CONAT-1 activity. Further preferred proteins include at least one acetyltransferase domain, and are, preferably, encoded by a nucleic acid molecule having a nucleotide sequence which hybridizes under stringent hybridization conditions to a complement of a nucleic acid molecule comprising the nucleotide sequence of SEQ ID NO:54, 56, or 58.

The nucleotide sequence of an isolated human CONAT-1 cDNA and the predicted amino acid sequence encoded by the CONAT-1 cDNA are shown in SEQ ID NOs:54 and 55, respectively. A plasmid containing the human CONAT-1 cDNA was deposited with the American Type Culture Collection (ATCC), 10801 University Boulevard, Manassas, Va. 20110-2209, on Jun. 13, 2001 and assigned Accession Number PTA-3436. This deposit will be maintained under the terms of the Budapest Treaty on the International Recognition of the Deposit of Microorganisms for the Purposes of Patent Procedure. This deposit were made merely as a convenience for those of skill in the art and is not an admission that a deposit is required under 35 U.S.C. §112.

A second predicted potential amino acid sequence of the human CONAT-1 cDNA is shown in SEQ ID NO: 57.

Gene Expression Analysis of 26320 (CONAT-1)

The tissue distribution of 26320 (CONAT-1) mRNA, as was determined by RT-PCR, in situ hybridization, and measured by quantitative PCR using the TaqMan® procedure as described below.

For in situ analysis, various tissues were frozen, sectioned, fixed, and probed using standard in situ hybridization methodologies.

CONAT-1 expression levels were measured in a variety of tissue and cell samples using the TaqMan® procedure. The TaqMan® procedure is a quantitative, real-time PCR-based approach to detecting mRNA. The RT-PCR reaction exploits the 5' nuclease activity of AmpITaq Gold™ DNA Polymerase to cleave a TaqMan® probe during PCR. Briefly, cDNA is generated from the samples of interest and serves as the starting materials for PCR amplification. In addition to the 5' and 3' gene-specific primers, a gene-specific oligonucleotide probe (complementary to the region being amplified) is included in the reaction (i.e., the TaqMan® probe). The TaqMan® probe includes the oligonucleotide with a fluorescent reporter dye covalently linked to the 5' end of the probe (such as FAM (6-carboxyfluorescein), TET (6-carboxy-4,7,2',7'-tetrachlorofluorescein), JOE (6-carboxy-4,5-dichloro-2,7-dimethoxyfluorescein), or VIC) and a quencher dye (TAMRA (6-carboxy-N,N,N',N'-tetramethylrhodamine) at the 3' end of the probe.

During the PCR reaction, cleavage of the probe separates the reporter dye and the quencher dye, resulting in increased fluorescence of the reporter. Accumulation of PCR products is detected directly by monitoring the increase in fluorescence of the reporter dye. When the probe is intact, the proximity of the reporter dye to the quencher dye results in suppression of the reporter fluorescence. During PCR, if the target of interest is present, the probe specifically anneals between the forward and reverse primer sites. The 5'-3' nucleolytic activity of the AmpliTaq™ Gold DNA Polymerase cleaves the probe between the reporter and the quencher only if the probe hybridizes to the target. The probe fragments are then displaced from the target, and polymerization of the strand continues. The 3' end of the probe is blocked to prevent extension of the probe during PCR. This process occurs in every cycle and does not interfere with the exponential accumulation of product.

Using these assays, it was determined that CONAT-1 mRNA was expressed at least in fetal liver, Hepa2 cells and osteoblasts. Increased CONAT-1 expression was also detected in 5/7 clinical colon tumors in comparison to 2/3 clinical normal colon tissues. Moderate to low expression was detected in colon primary tumor cells (2/3) and liver metastasis cells (2/2), but not normal colon cells (0/2). In the lung, little or no expression was seen in tumor cells (2/5 tumor, 0/3 normal). In breast, little or no expression was seen in tumor epithelium (1/3 tumor, 0/3 normal). According to expression profiling (e.g., HMPGv2) analysis, increased expression of human CONAT-1 was detected in APC$^{min}$ adenomas as compared to normal small intestine. These data reveal that there exists a correlation between tumors (e.g., colon tumors) and CONAT-1 expression. Moreover, according to a cDNA library array analysis, high expression of CONAT-1 was detected in U937, HL60 and K563 cells.

These data reveal a significant upregulation of CONAT-1 mRNA in at least colon tumor, and thus, altered CONAT-1 expression may be involved in the regulation of gene expression associated with cell growth, differentiation, migration, and apoptosis in the colon and may result in perturbed cellular proliferation, which in turn can lead to cellular proliferative and/or differentiative disorders in colon tissues. Given that the mRNA for CONAT-1 is expressed in a variety of tumors, it is believed that CONAT-1 may serve as a good tumor and/or metastatic marker. Moreover, inhibition of CONAT-1 activity may inhibit tumor progression.

Human 46619

The present invention is based, in part, on the discovery of a novel human fatty acid synthase enzyme, referred to herein as "46619" or "beta-ketoacyl synthase". The nucleotide sequence of a cDNA encoding 46619 or beta-ketoacyl synthase is shown in SEQ ID NO:59 (nucleotides 58-1437) and SEQ ID NO:61 (nucleotides 1-1380), and the amino acid sequence of a beta-ketoacyl synthase polypeptide is shown in SEQ ID NO:60.

PFAM analysis indicates that the 46619 polypeptide shares a high degree of sequence similarity with beta-ketoacyl synthase. For general information regarding PFAM identifiers, PS prefix and PF prefix domain identification numbers, refer to Sonnhammer et al. (1997) *Protein* 28:405-420.

Fatty acid biosynthesis in animals occurs in a multienzyme complex known as fatty acid synthase. The complex catalyzes the synthesis of the long-chain fatty acid palmitate from acetyl-CoA, malonyl-CoA, and NADPH (Wakil (1989) *Biochemistry* 28: 4523-4530). In addition to enzymes, the complex includes acyl carrier protein (ACP). The use of the multienzyme complex, together with the coenzyme attachment of intermediates greatly increases the efficiency of fatty acid synthesis. (Zubay (1988) "*Biochemistry*" 2d ed., Macmillan Publishing Company). There are seven reactions which are catalyzed by the fatty acid synthase complex. Beta-ketoacyl synthase is one of the enzymes involved in a condensation type reaction in fatty acid biosynthesis.

Animal fatty acid synthase (FAS) consists of two identical polypeptides each carrying six enzymes and an acyl carrier protein that are juxtaposed to form two centers for the synthesis of palmitic acid from acetyl- and malonyl-CoA. The six catalytic domains are clusterd in two regions separated by approximately 600 residues. The beta-ketoacyl synthase, malonyl/acetyl transferase, and dehydrase domains are located within the amino-terminal half of the polypeptide, whereas the enoyl reductase, beta-ketoacyl reductase and thioesterase are located in the carboxy-terminal half: the ACP domain is located between the beta-ketoacyl reductase and thioesterase domains (Rangan et al. (1998) *J. Biol. Chem.* 273(52): 34949-34953).

The order of the various FAS activities along the polypeptide have been established: beta-ketoacyl synthase; acetyl-CoA and malony-CoA transacylases; beta-hydroxyacyl dehydratase; enoyl reductase; beta-ketoacyl reductase; the site for the prosthetic group; 4'-phosphopantetheine (ACP); and the thioreductase (Jayakumar et al. (1996) *Proc. Natl. Acad. Sci. USA* 93: 14509-14514).

Human FAS has been used successfully as a prognostic factor in identifying patients with breast cancer who have a markedly worse prognosis (Kuhajda et al. (1994) *Proc. Natl. Acad. Sci.* 91: 6379-6383). Also, breast tumors marked with high levels of FAS are four times more likely to recur metastasize than those not so marked. Also, investigators have found an association between high levels of FAS expression and a worsened prognosis in patients with adenocarcinoma of the prostrate (Shurbaji et al. (1992) *Am. J. Clin. Path.* 97:686-691) or colon (Redston et al. (1992) *Lab. Invest.* 66, 47A (abstract)).

To identify the presence of a "beta-ketoacyl synthase" domain in a 46619-like protein sequence, and make the determination that a polypeptide or protein of interest has a particular profile, the amino acid sequence of the protein can be searched against a database of HMMs (e.g., the Pfam database, release 2.1) using the default parameters. For example, the hmmsf program, which is available as part of the HMMER package of search programs, is a family specific default program for MILPAT0063 and a score of 15 is the default threshold score for determining a hit. Alternatively, the threshold score for determining a hit can be lowered (e.g., to 8 bits). A description of the Pfam database can be found in Sonhammer et al. (1997) *Proteins* 28(3):405-420 and a detailed description of HMMs can be found, for example, in Gribskov et al. (1990) *Methyl. Enzymol.* 183:146-159; Gribskov et al. (1987) *Proc. Natl. Acad. Sci. USA* 84:4355-4358; Krogh et al. (1994) *J. Mol. Biol.* 235:1501-1531; and Stultz et al. (1993) *Protein Sci.* 2:305-314, the contents of which are incorporated herein by reference.

As used herein, the term "beta-ketoacyl synthase domain" includes an amino acid sequence of about 415 amino acid residues in length and having a bit score for the alignment of the sequence to the beta-ketoacyl synthase domain (HMM) of at least 8. Preferably, a beta-ketoacyl synthase domain includes at least about 100-415 amino acids, more preferably about 130-300 amino acid residues, or about 160-200 amino acids and has a bit score for the alignment of the sequence to the beta-ketoacyl synthase domain (HMM) of at least 16 or greater. A search was performed against the HMM database resulting in the identification of a beta-ketoacyl synthase domain in the amino acid sequence of human 46619 at about amino acid residues 44-459 of SEQ ID NO:60 (the identified beta-ketoacyl synthase domain corresponds to SEQ ID NO:62).

In a preferred embodiment beta-ketoacyl synthase polypeptide or protein has a "beta-ketoacyl synthase domain" or a region which includes at least about 100-415, more preferably about 130-300 or 160-200 amino acid residues and has at least about 60%, 70%, 80%, 90%, 95%, 99%, or 100% sequence identity with an "beta-ketoacyl synthase domain," e.g., the beta-ketoacyl synthase domain of human beta-ketoacyl synthase polypeptide or protein (e.g., amino acid residues 44-459 of SEQ ID NO:60).

In one embodiment, a beta-ketoacyl synthase protein includes at least one transmembrane domain. As used herein, the term "transmembrane domain" includes an amino acid sequence of about 15 amino acid residues in length that spans a phospholipid membrane. More preferably, a transmembrane domain includes about at least 16, 18, 20, 22, or 24 amino acid residues and spans a phospholipid membrane. Transmembrane domains are rich in hydrophobic residues, and typically have an α-helical structure. In a preferred embodiment, at least 50%, 60%, 70%, 80%, 90%, 95% or more of the amino acids of a transmembrane domain are hydrophobic, e.g., leucines, isoleucines, tyrosines, or tryptophans. Transmembrane domains are described in, for example, Zagotta et al., (1996) *Annual Rev. Neuronsci.* 19: 235-63, the contents of which are incorporated herein by reference.

In a preferred embodiment, a beta-ketoacyl synthase polypeptide or protein has at least one transmembrane domain or a region which includes at least 16, 18, 20, 22, or 24 amino acid residues and has at least about 60%, 70% 80% 90% 95%, 99%, or 100% homology with a "transmembrane domain," e.g., at least one transmembrane domain of human beta-ketoacyl synthase (e.g., amino acid residues 44-63, 144-160, 230-248, or 386-404 of SEQ ID NO:60).

In another embodiment, a beta-ketoacyl synthase polypeptide or protein includes at least one "non-transmembrane domain." As used herein, "non-transmembrane domains" are domains that reside outside of the membrane. When referring to plasma membranes, non-transmembrane domains include extracellular domains (i.e., outside of the cell) and intracellular domains (i.e., within the cell). When referring to membrane-bound proteins found in intracellular organelles (e.g., mitochondria, endoplasmic reticulum, peroxisomes and microsomes), non-transmembrane domains include those domains of the protein that reside in the cytosol (i.e., the cytoplasm), the lumen of the organelle, or the matrix or the intermembrane space (the latter two relate specifically to mitochondria organelles). The C-terminal amino acid residue of a non-transmembrane domain is adjacent to an N-terminal amino acid residue of a transmembrane domain in a naturally occurring beta-ketoacyl synthase polypeptide or protein.

In a preferred embodiment, a beta-ketoacyl synthase polypeptide or protein has a "non-transmembrane domain" or a region which includes at least about 1-130, preferably about 25-100, more preferably about 50-90, and even more preferably about 60-80 amino acid residues, and has at least about 60%, 70% 80% 90% 95%, 99% or 100% sequence identity with a "non-transmembrane domain", e.g., a non-transmembrane domain of human beta-ketoacyl synthase polypeptide or protein (e.g., residues 1-43; 64-143; 161-229; 249-385; 405-459 of SEQ ID NO:60). Preferably, a non-transmembrane domain is capable of catalytic activity (e.g., ketoacyl synthase).

A non-transmembrane domain located at the N-terminus of a beta-ketoacyl synthase polypeptide or protein is referred to herein as an "N-terminal non-transmembrane domain." As used herein, an "N-terminal non-transmembrane domain" includes an amino acid sequence having about 1-43, preferably about 10-40, more preferably about 20-35, or even more preferably about 25-30 amino acid residues in length and is located outside the boundaries of a membrane. For example, an N-terminal non-transmembrane domain is located at about amino acid residues 1-43 of SEQ ID NO:60.

Similarly, a non-transmembrane domain located at the C-terminus of a beta-ketoacyl synthase polypeptide or protein is referred to herein as a "C-terminal non-transmembrane domain." As used herein, an "C-terminal non-transmembrane domain" includes an amino acid sequence having about 1-54, preferably about 15-50, preferably about 20-45, more preferably about 25-40 amino acid residues in length and is located outside the boundaries of a membrane. For example, an C-terminal non-transmembrane domain is located at about amino acid residues 405-459 of SEQ ID NO:60.

A beta-ketoacyl synthase polypeptide or protein molecule can further include a signal sequence. As used herein, a "signal sequence" refers to a peptide of about 20-80 amino acid residues in length which occurs at the N-terminus of secretory and integral membrane proteins and which contains a majority of hydrophobic amino acid residues. For example, a signal sequence contains at least about 12-25 amino acid residues, preferably about 30-50 amino acid residues, more preferably about 58 amino acid residues, and has at least about 40-70%, preferably about 50-65%, and more preferably about 55-60% hydrophobic amino acid residues (e.g., alanine, valine, leucine, isoleucine, phenylalanine, tyrosine, tryptophan, or proline). Such a "signal sequence", also referred to in the art as a "signal peptide", serves to direct a protein containing such a sequence to a lipid bilayer. For example, in one embodiment, a beta-ketoacyl synthase polypeptide or protein contains a signal sequence of about amino acids 1-58 of SEQ ID NO:60. The "signal sequence" is cleaved during processing of the mature protein. The mature beta-ketoacyl synthase polypeptide or protein corresponds to amino acids 59-459 of SEQ ID NO:60.

Human beta-ketoacyl synthase contains the following regions or other structural features: a predicted beta-ketoacyl synthase active site located at about amino acid residues 200 to 216 of SEQ ID NO:60; and MEMSAT predicted transmembrane domains which extend from about amino acid residue 44 to 63; 144 to 160; 230 to 248; and 386 to 404 of SEQ ID NO:60.

The beta-ketoacyl synthase protein also includes the following domains: N-glycosylation site at AA 451 to 454 of SEQ ID NO:60; protein kinase C phosphorylation sites at AA 13 to 15, AA 27 to 29, AA 193 to 195, AA 219 to 221, AA 378 to 380, AA 434 to 436 of SEQ ID NO:60; casein kinase II phosphorylation sites at AA 108 to 111, AA 139 to 142, AA 256 to 259, AA 315 to 318, and AA 416 to 419 of SEQ ID NO:60; tryrosine kinase phosphorylation site at AA 297 to 305 of SEQ ID NO:60; N-myristoylation sites at AA 68 to 73, AA 95 to 100, AA 147 to 152, AA 234 to 239, AA 323 to 328, AA 388 to 393 of SEQ ID NO:60, ribosomal protein S14 signature at AA 20 to 43 of SEQ ID NO:60; and a beta-ketoacyl synthase signature at AA 200 to 216 of SEQ ID NO:60.

As used herein, the term "beta-ketoacyl synthase" refers to a protein or polypeptide which is capable of forming acetoacetyl-ACP. In this condensation reaction, the acetyl group is transferred from the cysteine-SH group to the malonyl group so that the aetyl group becomes the methyl terminal two-carbon unit of the new acetoacetyl group. Assays for beta-ketoacyl synthases have been previously described (Joshi et al. (1993) *Biochem. J.* 296:143-149) and (Kim et al. (1977) *Arch. Biochem. Biophys.* 178:475-485). See also Juayakumar et al. (1995) *Biochemistry* 92:8695-8699 and Stoops et al. (1981) *J. Biol. Chem.* 256:5128-5133.

Typically, beta-ketoacyl synthases play a role in diverse cellular processes. For example, the biosynthesized fatty acids are incorporated into the membrane lipids and can be used for long-term energy storage. In animals, liver is the primary tissue in which fatty acids are synthesized and their usual fate is to be used in the biosynthesis of triacylglycerols. Catabolism of triacylglycerols results in the release of fatty acids that are absorbed by various tissues. There they can be degraded to satisfy immediate energy needs or reesterified into phospholipids for membrane assembly.

A beta-ketoacyl synthase polypeptide can include a "beta-ketoacyl synthase active site" or regions homologous with a "beta-ketoacyl synthase active site".

As the beta-ketoacyl synthase polypeptides of the invention may modulate beta-ketoacyl synthase-mediated activities, they may be useful for developing novel diagnostic and therapeutic agents for beta-ketoacyl synthase-mediated or related disorders, as described below.

As used herein, a "beta-ketoacyl synthase activity", "biological activity of beta-ketoacyl synthase" or "functional activity of beta-ketoacyl synthase", refers to an activity exerted by a beta-ketoacyl synthase protein, polypeptide or nucleic acid molecule on e.g., a beta-ketoacyl synthase-responsive cell or on a beta-ketoacyl synthase substrate, e.g., acyl or malonyl groups or as determined in vivo or in vitro. In one embodiment, a beta-ketoacyl synthase activity is a direct activity, such as an association with a beta-ketoacyl synthase target molecule. A "target molecule" or "binding partner" is a molecule with which a beta-ketoacyl synthase protein binds or interacts in nature.

Gene Expression Analysis of 46619

Expression levels of 46619 in various tissue and cell types were determined by quantitative RT-PCR (Reverse Transcriptase Polymerase Chain Reaction; TaqMan® brand PCR kit, Applied Biosystems). The quantitative RT-PCR reactions were performed according to the kit manufacturer's instructions.

Expression of 46619 was observed in the following cells and tissues: Coronary smooth muscle cells, human umbilical vein endothelial cells, normal heart, congestive heart failure tissue, kidney, skeletal muscle, pancreas, normal brain cortex, normal ovary, ovary tumor, normal prostate, prostate tumor, normal colon, colon tumor, normoxic colon cancer, hypoxic colon cancer, lung tumor, inflammatory bowel disease colon tissue, normal liver, normal tonsil, megakaryocytes and erythroid.

In the prostate, colon, and lung, 46619 expression levels were found to be elevated in tumor tissue as compared with normal tissue. Expression of 46619 was also observed in ovary tumor, normal liver, proliferating human umbilical vein endothelial cells, normoxic colon cancer, hypoxic colon cancer and breast tumor.

Accordingly, beta-ketoacyl synthase protein may be mediate various disorders, including cellular proliferative and/or differentiative disorders, prostate disorders, colon disorders, lung disorders, ovarian disorders, breast disorders, kidney disorders, pancreatic disorders, brain disorders, heart disorders, blood vessel disorders, and platelet disorders.

Human 33166

The present invention provides alpha/beta hydrolase-like molecules. By "alpha/beta hydrolase-like molecules" is intended a novel human sequence referred to as 33166, and variants and fragments thereof. These full-length gene sequences or fragments thereof are referred to as "alpha/beta hydrolase-like" sequences, indicating they share sequence similarity with alpha/beta hydrolase genes. Isolated nucleic acid molecules comprising nucleotide sequences encoding the 33166 polypeptide whose amino acid sequence is given in SEQ ID NO:64, or a variant or fragment thereof, are provided. A nucleotide sequence encoding the 33166 polypeptide is set forth in SEQ ID NO:63 and 65. The sequences are members of the ABH fold family of proteins.

The alpha/beta hydrolase (ABH) fold family of proteins encompasses members with diverse phylogenetic origin and function. The majority of the ABH fold proteins are hydrolytic enzymes catalyzing hydrolysis of a wide variety of bonds including ester, amide, epoxide, C-halogen, and even C—C bonds. Enzyme members include lipases, esterases, proteases, and various other enzymes. Nonenzyme proteins in this family include proteins such as glutactin, vitellogenin, thyroglobulin, and neuroligin. (Fischer et al. (1999) *Journal of Bacteriology* 181(18): 5725-5733; Zhang, et al, (1998) *Folding & Design* 3(6): 535-548).

Lipase members of the ABH family include hepatic-, glycerol-, bacterial-, pancreatic, lipoprotein- and hormone sensitive lipases. Esterase members include cutinase, thioesterase, carboxylesterase, cholesterol esterase, acetylcholinesterase, and butyrylcholinesterase. Protease members include carboxypeptidase and prolyl aminopeptidase. Other enzymes in this family include bacterial 2,4-dioxygenases, bromoperoxidase, hydroxynitrile lyase, sterol acyltransferase, hydrolase, haloalkane dehalogenase (Morel, et al. (1999) *Biochimica et Biophysica Acta—Protein & Molecular Enzymology* 1429 (2): 501-505; Fischer et al., 1999, *Journal of Bacteriology* 181(18): 5725-5733; Zhang, et al. (1998) *Folding & Design* 3(6): 535-548).

The involvement of lipases in lipid and cholesterol metabolism is well known. Likewise, the involvement of serine hydrolases such as carboxylesterase, cholesterol esterase, acetylcholinesterase, and butyrylcholinesterase in pharmacology and toxicology are well known. For example, acetylcholinesterase inhibitors are useful as insecticides due to their toxic effects and as therapeutic agents for treatment of Alzheimer's disease, myasthenia gravis and glaucoma. Another member of the ABH superfamily with recognized pharmacological significance is epoxide hydrolase which is involved in detoxification of highly harmful aromatic compounds in mammals. The human hormone sensitive lipase performs the important rate-limiting step of hydrolysing fat stored in adipocytes. See, for example Heikinheimo et al (1999) *Structure.* 7(6): R141-R146; Satoh and Hosokawa (1995), *Toxicol Lett:* 439-45.

The ABH fold family was initially identified by comparing several divergent hydrolytic enzymes having a core topology of eight beta-sheets connected by alpha-helices, and a conserved catalytic triad (Ollis et al. (1992) *Protein Eng* 5(3): 197-211). With the growth of the family, the topology has been expanded to encompasses other variations. Nevertheless, the catalytic triad of nucleophilic-, acidic-, and histidine residues remains a common feature among the enzyme members of the family. For example, Heikinheimo et al. (1999) *Structure* 7(6): R141-R146, describe nine variations of the ABH fold structures, in addition to a canonical and minimal structure; all having the catalytic triad residues. Within the catalytic triad, the nucleophile residue has included serine, cysteine or aspartate; and the acid residue has included glutamate. Further information on structural and functional aspects of ABH fold proteins are available, for example, as described by Zhang et al., (1998) *Folding & Design* 3(6): 535-548;

A novel human alpha/beta hydrolase-like gene sequence, referred to as 33166, is provided. This gene sequence and variants and fragments thereof are encompassed by the term "alpha/beta hydrolase-like" molecules or sequences as used herein. The alpha/beta hydrolase-like sequences find use in modulating an alpha/beta hydrolase-like function. By "modulating" is intended the upregulating or downregulating of a response. That is, the compositions of the invention affect the targeted activity in either a positive or negative fashion. The sequences of the invention find use in modulating the processes including, but not limited to lipid and cholesterol metabolism; biotransformation of drugs and other chemicals; detoxification; neurotransmission; cellular cycle regulation, growth and differentiation. The disclosed invention relates to methods and compositions for the modulation, diagnosis, and treatment of disorders associated with these processes including, but not limited to hyperproliferative and neurogenerative disorders, and drug-induced toxicities. Examples of such disorders include but are not limited to cancers, Alzheimer's disease, atherosclerosis, and arene oxide-related toxicity. More particularly, cancers of the breast, lung, colon, brain and ovary may be treated with the 33166 gene or variants or fragments thereof. Additionally, a polypeptide comprising the amino acid sequence of SEQ ID NO:64 or a naturally occurring variant or fragment thereof may be used to treat such cancers.

In particular, the 33166 gene is associated with lung and breast cancer. TaqMan® analysis revealed that 33166 was expressed at high levels in human breast carcinoma samples in comparison to normal human breast tissue samples. Also, as revealed by TaqMan® data, 33166 was modestly upregulated in some breast and lung tumors in comparison to normal breast and lung tissues. Inhibition of this alpha1 beta hydrolase may inhibit tumor progression.

The alpha/beta hydrolase-like gene, clone 33166, was identified in a primary human ostaoblast cDNA library. Clone 33166 encodes an approximately 2.1 Kb mRNA transcript having the corresponding cDNA set forth in SEQ ID NO:63. This transcript has a 1320 nucleotide open reading frame, (nucleotides 172-1491 of SEQ ID NO:63 corresponding to nucleotides designated 1-1320 in SEQ ID NO:65), which encodes a 439 amino acid protein (SEQ ID NO:64) having a molecular weight of approximately 48.2 kDa. An analysis of the full-length 33166 polypeptide predicts that the N-terminal 21 amino acids represent a signal peptide. Transmembrane segments from amino acids (AA) 174-191, 214-231, and 247-263 of SEQ ID NO:64 were predicted by MEMSAT. Transmembrane segments were also predicted from AA 154-171, 194-211, and 227-243 of the presumed mature peptide sequence of SEQ ID NO:64. Prosite program analysis was used to predict various sites within the 33166 protein. N-glycosylation sites were predicted at AA 108-111, and 332-335 of SEQ ID NO:64. Glycosaminoglycan attachment sites were predicted at AA 138-141, and AA 142-145 of SEQ ID NO:64. cAMP- and cGMP-dependent protein kinase phosphorylation sites were predicted at AA 80-83 and 164-167 of SEQ ID NO:64. Protein kinase C phosphorylation sites were predicted at AA 168-170, and 423-425 of SEQ ID NO:64. Casein kinase II phosphorylation sites were predicted at AA 34-37, and 281-284 of SEQ ID NO:64. N-myristoylation sites were predicted at AA 4-9, 15-20, 74-79, 106-111, 134-139, 141-146, 183-188, 254-259, 277-282, and 328-333 of SEQ ID NO:64. An amidation site was predicted at AA 145-148 of SEQ ID NO:64.

The alpha/beta hydrolase-like protein possesses an alpha/beta hydrolase domain, from AA 203-416 of SEQ ID NO:64, as predicted by HMMer, Version 2. The canonical form of this domain has a core topology of eight beta-sheets connected by alpha-helices, and a conserved catalytic triad (Ollis et al. (1992) Protein Eng 5(3): 197-211). This topology has been expanded to encompasses other variations; however, the catalytic triad of nucleophilic-, acidic-, and histidine residues are conserved as described herein. See for example, Heikinheimo et al. (1999) Structure 7(6): R141-R146; the ESTHER database.

The alpha/beta hydrolase-like protein displays identity to several ProDom consensus sequences including 29% identity to a carboxylesterase sequence over a 131 amino acid overlap; 27% identity to an epoxide hydrolase sequence over a 90 amino acid overlap; 22% identity to a lipase sequence over a 131 amino acid overlap; 30% identity over a 99 amino acid overlap; 26% identity over a 129 amino acid overlap; and 25% identity to a DNA polymerase over a 112 amino acid overlap. Examples of proteins comprising domains from each of these consensus sequences include hypothetical proteins of *Escherichia coli*; E1-E2 ATPases of *Mycobacterium tuberculosis* and *Sacchromyces cerevisiae*; a putative esterase/lipase from *Mycoplasma genitalium*; a hypothetical protein from *Methanococcus jannaschi*; a protein kinase-like protein from *Arabidopsis thaliana*; and a Mycobacteriophage TM4 protein respectively.

A plasmid containing the 33166 cDNA insert was deposited with American Type Culture Collection (ATCC), 10801 University Boulevard, Manassas, Va., on Aug. 10, 2000, and assigned Accession Number PTA-2339. This deposit will be maintained under the terms of the Budapest Treaty on the International Recognition of the Deposit of Microorganisms for the Purposes of Patent Procedure. This deposit was made merely as a convenience for those of skill in the art and is not an admission that a deposit is required under 35 U.S.C. ∃112.

The alpha/beta hydrolase-like sequences of the invention are members of a family of molecules having conserved structural features. The term "family" when referring to the proteins and nucleic acid molecules of the invention is intended to mean two or more proteins or nucleic acid molecules having sufficient amino acid or nucleotide sequence identity as defined herein. Such family members can be naturally occurring and can be from either the same or different species. For example, a family can contain a first protein of murine origin and a homologue of that protein of human origin, as well as a second, distinct protein of human origin and a murine homologue of that protein. Members of a family may also have common functional characteristics.

Preferred alpha/beta hydrolase-like polypeptides of the present invention have an amino acid sequence sufficiently identical to the amino acid sequence of SEQ ID NO:64. The term "sufficiently identical" is used herein to refer to a first amino acid or nucleotide sequence that contains a sufficient or minimum number of identical or equivalent (e.g., with a similar side chain) amino acid residues or nucleotides to a second amino acid or nucleotide sequence such that the first and second amino acid or nucleotide sequences have a common structural domain and/or common functional activity. For example, amino acid or nucleotide sequences that contain a common structural domain having at least about 45%, 55%, or 65% identity, preferably 75% identity, more preferably 85%, 95%, or 98% identity are defined herein as sufficiently identical.

To determine the percent identity of two amino acid sequences or of two nucleic acids, the sequences are aligned for optimal comparison purposes. The percent identity between the two sequences is a function of the number of identical positions shared by the sequences (i.e., percent identity=number of identical positions/total number of positions (e.g., overlapping positions)×100). In one embodiment, the two sequences are the same length. The percent identity between two sequences can be determined using techniques similar to those described below, with or without allowing gaps. In calculating percent identity, typically exact matches are counted.

The determination of percent identity between two sequences can be accomplished using a mathematical algorithm. A preferred, nonlimiting example of a mathematical algorithm utilized for the comparison of two sequences is the algorithm of Karlin and Altschul (1990) *Proc. Natl. Acad. Sci. USA* 87:2264, modified as in Karlin and Altschul (1993) *Proc. Natl. Acad. Sci. USA* 90:5873-5877. Such an algorithm is incorporated into the NBLAST and XBLAST programs of Altschul et al. (1990) *J. Mol. Biol.* 215:403. BLAST nucleotide searches can be performed with the NBLAST program, score=100, wordlength=12, to obtain nucleotide sequences homologous to alpha/beta hydrolase-like nucleic acid molecules of the invention. BLAST protein searches can be performed with the XBLAST program, score=50, wordlength=3, to obtain amino acid sequences homologous to alpha/beta hydrolase-like protein molecules of the invention. To obtain gapped alignments for comparison purposes, Gapped BLAST can be utilized as described in Altschul et al. (1997) *Nucleic Acids Res.* 25:3389. Alternatively, PSI-Blast can be used to perform an iterated search that detects distant relationships between molecules. See Altschul et al. (1997) supra. When utilizing BLAST, Gapped BLAST, and PSI-Blast programs, the default parameters of the respective programs (e.g., XBLAST and NBLAST) can be used. Another preferred, non-limiting example of a mathematical algorithm utilized for the comparison of sequences is the algorithm of Myers and Miller (1988) *CABIOS* 4:11-17. Such an algorithm is incorporated into the ALIGN program (version 2.0), which is part of the GCG sequence alignment software package. When utilizing the ALIGN program for comparing amino acid sequences, a PAM120 weight residue table, a gap length penalty of 12, and a gap penalty of 4 can be used.

Accordingly, another embodiment of the invention features isolated alpha/beta hydrolase-like proteins and polypeptides having an alpha/beta hydrolase-like protein activity. As used interchangeably herein, a "alpha/beta hydrolase-like protein activity", "biological activity of an alpha/beta hydrolase-like protein", or "functional activity of an alpha/beta hydrolase-like protein" refers to an activity exerted by an alpha/beta hydrolase-like protein, polypeptide, or nucleic acid molecule on an alpha/beta hydrolase-like responsive cell as determined in vivo, or in vitro, according to standard assay techniques. An alpha/beta hydrolase-like activity can be a direct activity, such as an association with or an enzymatic activity on a second protein, or an indirect activity, such as a cellular signaling activity mediated by interaction of the alpha/beta hydrolase-like protein with a second protein. In a preferred embodiment, an alpha/beta hydrolase-like activity includes at least one or more of the following activities: (1) modulating (stimulating and/or enhancing or inhibiting) cellular cycle regulation, proliferation, differentiation, growth and/or function (2) modulating lipid and cholesterol metabolism; (3) modulating biotransformation of drugs and other chemicals; 4) modulating detoxification, particularly of aromatic compounds; 5) modulating neurotransmission; 6) modulating an enzyme activity selected from a lipase, esterase, and/or a protease activity.

An "isolated" or "purified" alpha/beta hydrolase-like nucleic acid molecule or protein, or biologically active portion thereof, is substantially free of other cellular material, or culture medium when produced by recombinant techniques, or substantially free of chemical precursors or other chemicals when chemically synthesized. Preferably, an "isolated" nucleic acid is free of sequences (preferably protein encoding sequences) that naturally flank the nucleic acid (i.e., sequences located at the SN and 3N ends of the nucleic acid) in the genomic DNA of the organism from which the nucleic acid is derived. For purposes of the invention, "isolated" when used to refer to nucleic acid molecules excludes isolated chromosomes. For example, in various embodiments, the isolated alpha/beta hydrolase-like nucleic acid molecule can contain less than about 5 kb, 4 kb, 3 kb, 2 kb, 1 kb, 0.5 kb, or 0.1 kb of nucleotide sequences that naturally flank the nucleic acid molecule in genomic DNA of the cell from which the nucleic acid is derived. An alpha/beta hydrolase-like protein that is substantially free of cellular material includes preparations of alpha/beta hydrolase-like protein having less than about 30%, 20%, 10%, or 5% (by dry weight) of non-alpha/beta hydrolase-like protein (also referred to herein as a "contaminating protein"). When the alpha/beta hydrolase-like protein or biologically active portion thereof is recombinantly produced, preferably, culture medium represents less than about 30%, 20%, 10%, or 5% of the volume of the protein preparation. When alpha/beta hydrolase-like protein is produced by chemical synthesis, preferably the protein preparations have less than about 30%, 20%, 10%, or 5% (by dry weight) of chemical precursors or non-alpha/beta hydrolase-like chemicals.

Isolation of 33166

Poly-A+ RNA from primary human osteoblasts were converted to be used to generate a cDNA library. EST sequencing was performed on this library, and greater than 10,000 sequences were subjected to database analysis together with other proprietary sequences.

From this analysis, overlapping sequences were combined into a single contiguous sequence. Upon further analysis, the clone 33166 was identified. Clone 33166 encodes an approximately 2.1 Kb mRNA transcript having the corresponding cDNA set forth in SEQ ID NO:63. This transcript has a 1320 nucleotide open reading frame (nucleotides 172-1491 of SEQ ID NO:63 corresponding to nucleotides designated 1-1320 in SEQ ID NO:65), which encodes a 439 amino acid protein (SEQ ID NO:64) having a molecular weight of approximately 48.2 kDa. HMMER (version 2) analysis also showed that the polypeptide belongs to the ABH fold protein family.

Human 16836

The human 16836 sequence (SEQ ID NO:66), which is approximately 10,172 nucleotides long including untranslated regions, contains a predicted coding sequence of about 5,430 nucleotides, including the termination codon (nucleotides indicated as coding of SEQ ID NO:66 in SEQ ID NO:68). The coding sequence encodes a 1809 amino acid protein (SEQ ID NO:67).

Human 16836 contains the following regions or structural features: a Ras guanine nucleotide exchange factor (RasGEF) domain (SEQ ID NO:69; SMART identifier RasGEF) located at about amino acid residues 35-338 of SEQ ID NO:67; a phosphatidylinositol-specific phospholipase C "X" (PI-PLC-X) domain (SEQ ID NO:70; PFAM Accession PF00388) located at about amino acid residues 900-1048 of SEQ ID NO:67; a phosphatidylinositol-specific phospholipase C "Y" (PI-PLC-Y) domain (SEQ ID NO:71 and 72; PFAM Accession PF00387) located at about amino acid residues 1171-1184 and 1261-1353 of SEQ ID NO:67; a C2 domain (SEQ ID NO:73; PFAM Accession PF00168) located at about amino acid residues 1378-1460 of SEQ ID NO:67; and a Ras association (RalGDS/AF-6) (RA) domain (SEQ ID NO:74; PFAM Accession PF00788) located at about amino acid residues 1640-1745 of SEQ ID NO:67.

The 16836 protein also includes the following domains: 16 predicted N-glycosylation sites (PS00001) located at about amino acids 285-288, 300-303, 395-398, 419-422, 583-586, 719-722, 752-755, 764-767, 770-773, 784-787, 817-820, 1115-1118, 1191-1194, 1224-1227, 1450-1453, and 1498-1501 of SEQ ID NO:67; six predicted cAMP- and cGMP-dependent protein kinase phosphorylation sites (PS00004) located at about amino acids 303-306, 559-562, 1162-1165, 1277-1280, 1707-1710, and 1764-1767 of SEQ ID NO:67; thirty predicted protein kinase C phosphorylation sites (PS00005) located at about amino acids 160-162, 177-179, 180-182, 268-270, 301-303, 306-308, 342-344, 384-386, 410-412, 501-503, 562-564, 571-573, 590-592, 613-615, 653-655, 686-688, 733-735, 736-738, 964-966, 1195-1197, 1203-1205, 1227-1229, 1258-1260, 1280-1282, 1492-1494, 1520-1522, 1705-1707, 1711-1713, 1715-1717, and 1769-1771 of SEQ ID NO:67; thirty seven predicted casein kinase II phosphorylation sites (PS00006) located at about amino acids 124-127, 173-176, 180-183, 190-193, 239-242, 251-254, 268-271, 290-293, 295-298, 306-309, 323-326, 437-440, 607-610, 626-629, 721-724, 736-739, 754-757, 766-769, 819-822, 849-852, 889-892, 927-930, 1054-1057, 1102-1105, 1117-1120, 1216-1219, 1230-1233, 1238-1241, 1266-1269, 1299-1302, 1364-1367, 1618-1621, 1638-1641, 1667-1670, 1749-1752, 1790-1793, and 1800-1803 of SEQ ID NO:67; sixteen predicted N-myristoylation sites (PS00008) located at about amino acids 71-76, 146-151, 264-269, 338-343, 416-421, 484-489, 587-592, 705-710, 820-825, 1194-1199, 1209-1214, 1234-1239, 1501-1506, 1541-1546, 1756-1761, and 1797-1802 of SEQ ID NO:67; one predicted amidation site (PS00009) located at about amino acids 557-560 of SEQ ID NO:67; and one predicted coiled coil domain at about amino acids 874-901 of SEQ ID NO:67.

The 16836 polypeptides of the invention include fragments which include: all or part of a hydrophobic sequence, e.g., the sequence from about amino acid 200-230, from about 430-450, and from about 830-840 of SEQ ID NO:67; all or part of a hydrophilic sequence, e.g., the sequence of from about amino acid 330-350, from about 610-630, and from about 1120-1140 of SEQ ID NO:67; a sequence which includes a Cys, or a glycosylation site.

For general information regarding PFAM identifiers, PS prefix and PF prefix domain identification numbers, refer to Sonnhammer et al. (1997) *Protein* 28:405-420.

A plasmid containing the nucleotide sequence encoding human 16836 (clone "Fbh16836FL") was deposited with American Type Culture Collection (ATCC), 10801 University Boulevard, Manassas, Va. 20110-2209, on Apr. 19, 2000 and assigned Accession Number PTA-1774. This deposit will be maintained under the terms of the Budapest Treaty on the International Recognition of the Deposit of Microorganisms for the Purposes of Patent Procedure. This deposit was made merely as a convenience for those of skill in the art and is not an admission that a deposit is required under 35 U.S.C. §112.

TABLE 10

Summary of Domains of 16836

| Domain | Location in SEQ ID NO: 67 |
|---|---|
| RasGEF | about amino acid residues 35-338 of SEQ ID NO: 67 |
| PI-PLC-X | about amino acid residues 900-1048 of SEQ ID NO: 67 |
| PI-PLC-Y | about amino acid residues 1171-1184 and 1261-1353 of SEQ ID NO: 67 |
| C2 | about amino acid residues 1378-1460 of SEQ ID NO: 67 |
| Ras association (RA) | about amino acid residues 1640-1745 of SEQ ID NO: 67 |

The 16836 protein contains a significant number of structural characteristics in common with members of the phospholipase C family. The term "family" when referring to the protein and nucleic acid molecules of the invention means two or more proteins or nucleic acid molecules having a common structural domain or motif and having sufficient amino acid or nucleotide sequence homology as defined herein. Such family members can be naturally or non-naturally occurring and can be from either the same or different species. For example, a family can contain a first protein of human origin as well as other distinct proteins of human origin, or alternatively, can contain homologues of non-human origin, e.g., rat or mouse proteins. Members of a family can also have common functional characteristics.

Phosphoinositide-specific phospholipase C (PI-PLC) mediates the cellular actions of a variety of hormones, neurotransmitters, and growth factors. Activation of PI-PLC is one of the early responses to various extracellular signals. Agonist-dependent activation of PI-PLC causes hydrolysis of membrane phosphatidylinositol 4,5-bisphosphate ($PIP_2$), generating the second messengers inositol 1,4,5-trisphosphate ($IP_3$) and diacylglycerol (DAG). $IP_3$ binds specific intracellular receptors to trigger $Ca^{2+}$ mobilization, while DAG mediates activation of a family of protein kinase C isozymes. This catalytic process is tightly regulated by reversible phosphorylation and binding of regulatory proteins (Rhee et al. (1997) *J. Biol. Chem.* 272:15045-15048).

In mammals, there are at least six different isoforms of PI-PLC, differing in their domain structure, regulation, and tissue distribution. Based on molecular size, immunoreactivity and amino acid sequence, several subtypes have been classified. Overall, sequence identity between sub-types is low, yet all isoforms share two conserved domains that constitute the PLC catalytic domain, designated X and Y: region X spans around 170 residues, and region Y about 260. The order of these two regions is always the same (NH2-X—Y—COOH), but the spacing is variable. In PLC-beta subtypes, X and Y domains are separated by a stretch of 70-120 amino acids rich in Ser, Thr and acidic residues, while their C-terminal 450 residues are rich in basic residues. In PLC-gammas, there is an insert of more than 400 residues containing one SH3 and two SH2 domains. PLCs show little similarity in the 300-residue N-terminal region preceding the X-domain. PI-PLCs have a C2 domain C-terminal of the catalytic domain. The C2 domain is thought to be involved in calcium-dependent phospholipid binding (Rhee et al. (1997) *J. Biol. Chem.* 272:15045-15048).

Members of the phosphoinositide-specific phospholipase C (PI-PLC) family of proteins are characterized by an amino acid sequence that catalyzes the hydrolysis of phosphatidyl-inositol-4,5-bisphosphate ($PIP_2$) to generate the second messengers inositol 1,4,5-trisphosphate ($IP_3$) and diacylglycerol (DAG). $IP_3$ can diffuse into the endoplasmic reticulum surface where it can bind an $IP_3$ receptor, inducing the release of $Ca^{2+}$ from intracellular stores into the cytoplasm. DAG remains in the cell membrane where it can serve to activate the enzyme protein kinase C. Both $Ca^{2+}$ release and protein kinase C activation are involved in cellular events such as proliferation, differentiation, secretion, and migration.

Members of the PI-PLC family generally share one or more of the following domains: a PI-PLC-X domain; a PI-PLC-Y domain; and a C2 domain. A PI-PLC-X domain is a subdomain of PI-PLC that, together with a PI-PLC-Y subdomain, constitutes the catalytic site of a phospholipase, e.g., a domain that catalyzes the hydrolysis of phosphatidylinositol. A C2 domain is a domain that can mediate calcium dependent binding to phospholipids.

The domain structure of 16836 is similar to the domain structure of a protein encoded by the *C. elegans* gene, PLC210 (Shibatohge et al. (1998) *J. Biol. Chem.* 273:6218-6222). PLC210 was isolated in a yeast two-hybrid screen for effectors of ras function. PLC210 binds preferentially to GTP-bound ras (active), suggesting that it functions in propagating or amplifying signals for cellular proliferation. In addition to a role for 16836 and PLC210 as ras effectors, their membership in the PI-PLC family also suggests a functional role for the protein in proliferation signaling.

16836 and PLC210 appear to contain domains not found in members of the three known classes of PI-PLCs. First, the N terminal region harbors a domain, a Ras guanine nucleotide exchange factor (RasGEF) domain, homologous to a family of guanine nucleotide exchange factors for ras. Second, the C terminal region contains a structure for ras binding, a ras association (RA) domain. A RA domain is a domain that can mediate binding to a ras protein. The RA domain associates preferentially with an activated ras, e.g. the RA domain may specifically associate with GTP-bound ras. Furthermore, the RA domain interacts with the effector region of ras. Thus, 16836 and PLC210 comprise a novel class of PI-PLC.

Ras may regulate the activity of 16836 by modulating one or more of: (1) an activation of 16836 activity; or (2) a ras-induced translocation of 16836 to a specific membrane compartment containing substrates upon which 16836 may act. The increased rate of phosphoinositide turnover observed in ras-transformed cells suggests a persistent PI-PLC stimulation by activated ras. Furthermore, anti-PI-PLC antibodies inhibit ras-induced mitogenesis. Thus, the regulation of PI-PLC by ras may play a role in controlling cell proliferation and/or differentiation.

A 16836 molecule can include a "Ras guanine nucleotide exchange factor (RasGEF)" domain or regions homologous with a "RasGEF" domain.

As used herein, the term "RasGEF domain" includes an amino acid sequence of about 50-400 amino acid residues in length and having a bit score for the alignment of the sequence to the RasGEF domain profile (SMART HMM) of at least 5. Preferably, a RasGEF domain includes at least about 80-350 amino acids, more preferably about 150-325 amino acid residues, or about 250-320 amino acids and has a bit score for the alignment of the sequence to the RasGEF domain (HMM) of at least 15 or greater. The RasGEF domain (HMM) has been assigned the SMART identifier RasGEF. The RasGEF domain (HMM) has been assigned the PFAM Accession Number PF00617.

In a preferred embodiment 16836 polypeptide or protein has a "RasGEF domain" or a region which includes at least about 80-350 more preferably about 150-325 or 250-320 amino acid residues and has at least about 50%, 60%, 70% 80% 90% 95%, 99%, or 100% homology with a "RasGEF domain," e.g., a RasGEF domain of human 16836 (e.g., residues 35-338 of SEQ ID NO:67).

A 16836 polypeptide can further include a "PI-PLC-X domain" or regions homologous with a "PI-PLC-X domain."

As used herein, the term "PI-PLC-X domain" includes an amino acid sequence of about 30-250 amino acid residues in length and having a bit score for the alignment of the sequence to the PI-PLC-X domain profile (PFAM HMM) of at least 50. Preferably, a PI-PLC-X domain includes at least about 100-220 amino acids, more preferably about 120-200 amino acid residues, or about 130-170 amino acids and has a bit score for the alignment of the sequence to the PI-PLC-X domain (HMM) of at least 240 or greater. The PI-PLC-X domain (HMM) has been assigned the PFAM Accession Number PF00388.

In a preferred embodiment 16836 polypeptide or protein has a "PI-PLC-X domain" or a region which includes at least about 100-220 more preferably about 120-200 or 130-170 amino acid residues and has at least about 50%, 60%, 70% 80% 90% 95%, 99%, or 100% homology with a "PI-PLC-X domain," e.g., the PI-PLC-X domain of human 16836 (e.g., residues 900-1048 of SEQ ID NO:67).

A 16836 molecule can further include a "PI-PLC-Y domain" or regions homologous with a "PI-PLC-Y domain."

As used herein, the term "PI-PLC-Y domain" includes an amino acid sequence of about 40-300 amino acid residues in length and having a bit score for the alignment of the sequence to the PI-PLC-Y domain profile (PFAM HMM) of at least 10. Preferably, a PI-PLC-Y domain includes at least about 60-260 amino acids, more preferably about 80-250 amino acid residues, or about 90-200 amino acids and has a bit score for the alignment of the sequence to the PI-PLC-X domain (HMM) of at least 140 or greater. The PI-PLC-Y domain (HMM) has been assigned the PFAM Accession Number PF00387.

In a preferred embodiment 16836 polypeptide or protein has a "PI-PLC-Y domain" or a region which includes at least about 60-260 more preferably about 80-250 or 90-200 amino acid residues and has at least about 50%, 60%, 70% 80% 90% 95%, 99%, or 100% homology with a "PI-PLC-Y domain," e.g., a PI-PLC-Y domain of human 16836 (e.g., residues 1171-1184 and 1261-1353 of SEQ ID NO:67).

A 16836 molecule can further include a "C2 domain" or regions homologous with a "C2 domain."

As used herein, the term "C2 domain" includes an amino acid sequence of about 20-200 amino acid residues in length and having a bit score for the alignment of the sequence to the C2 domain profile (PFAM HMM) of at least 15. Preferably, a C2 domain includes at least about 50-120 amino acids, more preferably about 70-100 amino acid residues, or about 80-90 amino acids and has a bit score for the alignment of the sequence to the C2 domain (HMM) of at least 35 or greater. The C2 domain (HMM) has been assigned the PFAM Accession Number PF00168.

In a preferred embodiment 16836 polypeptide or protein has a "C2 domain" or a region which includes at least about 50-120 more preferably about 70-100 or 80-90 amino acid residues and has at least about 50%, 60%, 70% 80% 90% 95%, 99%, or 100% homology with a "C2 domain," e.g., a C2 domain of human 16836 (e.g., residues 1378-1460 of SEQ ID NO:67).

A 16836 molecule can further include a "Ras association (RA) domain" or regions homologous with a "RA domain."

As used herein, the term "RA domain" includes an amino acid sequence of about 20-200 amino acid residues in length and having a bit score for the alignment of the sequence to the RA domain profile (PFAM HMM) of at least 2. Preferably, a RA domain includes at least about 50-140 amino acids, more preferably about 80-120 amino acid residues, or about 90-110 amino acids and has a bit score for the alignment of the sequence to the RA domain (HMM) of at least 3 or greater. The RA domain (HMM) has been assigned the PFAM Accession Number PF00788.

In a preferred embodiment 16836 polypeptide or protein has a "RA domain" or a region which includes at least about 50-140 more preferably about 80-120 or 90-110 amino acid residues and has at least about 50%, 60%, 70% 80% 90% 95%, 99%, or 100% homology with a "RA domain," e.g., a RA domain of human 16836 (e.g., residues 1640-1745 of SEQ ID NO:67).

To identify the presence of a "PI-PLC-X" domain, a "PI-PLC-Y" domain, a "C2" domain, or a "RA" domain in a 16836 protein sequence, and make the determination that a polypeptide or protein of interest has a particular profile, the amino acid sequence of the protein can be searched against the PFAM database of HMMs (e.g., the Pfam database, release 2.1) using the default parameters. For example, the hmmsf program, which is available as part of the HMMER package of search programs, is a family specific default program for MILPAT0063 and a score of 15 is the default threshold score for determining a hit. Alternatively, the threshold score for determining a hit can be lowered (e.g., to 8 bits). A description of the PFAM database can be found in Sonhammer et al. (1997) *Proteins* 28(3):405-420 and a detailed description of HMMs can be found, for example, in Gribskov et al. (1990) *Meth. Enzymol.* 183:146-159; Gribskov et al. (1987) *Proc. Natl. Acad. Sci. USA* 84:4355-4358; Krogh et al. (1994) *J. Mol. Biol.* 235:1501-1531; and Stultz et al. (1993) *Protein Sci.* 2:305-314, the contents of which are incorporated herein by reference. A search was performed against the HMM database resulting in the identification of a "PI-PLC-X" domain in the amino acid sequence of human 16836 at about residues 900 to 1048 of SEQ ID NO:67 (the identified Pfam "PI-PLC-X" domain consensus amino acid sequence of human 16836 corresponds to SEQ ID NO:70). A search was performed against the HMM database resulting in the identification of a "PI-PLC-Y" domain(s) in the amino acid sequence of human 16836 at about residues 1171 to 1184 and 1261 to 1353 of SEQ ID NO:67 (the identified Pfam "PI-PLC-Y" domain consensus amino acid sequences of human 16836 corresponds to SEQ ID NO:71 and 72). A search was performed against the HMM database resulting in the identification of a "C2" domain in the amino acid sequence of human 16836 at about residues 1378 to 1460 of SEQ ID NO:67 (the identified Pfam "C2" domain consensus amino acid sequence of human 16836 corresponds to SEQ ID NO:73). A search was performed against the HMM database resulting in the identification of a "Ras association (RalGDS/AF-6)" domain in the amino acid sequence of human 16836 at about residues 1640 to 1745 of SEQ ID NO:67 (the identified Pfam "Ras association (RalGDS/AF-6)" domain consensus amino acid sequence of human 16836 corresponds to SEQ ID NO:74).

To identify the presence of a "RasGEF" domain in a 16836 protein sequence, and make the determination that a polypeptide or protein of interest has a particular profile, the amino acid sequence of the protein can be searched against a SMART database (Simple Modular Architecture Research Tool) of HMMs as described in Schultz et al. (1998), *Proc. Natl. Acad. Sci. USA* 95:5857 and Schultz et al. (200) *Nucl. Acids Res* 28:231. The database contains domains identified by profiling with the hidden Markov models of the HMMer2 search program (R. Durbin et al. (1998) *Biological sequence analysis: probabilistic models of proteins and nucleic acids.* Cambridge University Press). The database also is extensively annotated and monitored by experts to enhance accuracy. A search was performed against the HMM database resulting in the identification of a "RasGEF" domain in the amino acid sequence of human 16836 at about residues 35 to 338 of SEQ ID NO:67 (the identified SMART "RasGEF" domain consensus amino acid sequence of human 16836 corresponds to SEQ ID NO:69).

A 16836 family member can include a RasGEF domain, a PI-PLC-X domain, at least one and preferably two PI-PLC-Y domains, a C2 domain, and/or or a RA domain.

Furthermore, a 16836 family member can include at least one, two, three, four, five, six, seven, eight, nine, 10, 11, 12, 13, 14, 15, and preferably 16 N-glycosylation sites (PS00001); at least one, two, three, four, five, and preferably six cAMP- and cGMP-dependent protein kinase phosphorylation sites (PS00004); at least one, two, three, four, five, six, seven, eight, nine, 10, 11, 12, 13, 14, 15, 16, 17, 18, 19, 20, 21, 22, 23, 24, 25, 26, 27, 28, 29, and preferably 30 protein kinase C phosphorylation sites (PS00005); at least one, two, three, four, five, six, seven, eight, nine, 10, 11, 12, 13, 14, 15, 16, 17, 18, 19, 20, 21, 22, 23, 24, 25, 26, 27, 28, 29, 30, 31, 32, 33, 34, 35, 36, and preferably 37 casein kinase II phosphorylation sites (PS00006); at least one, two, three, four, five, six, seven, eight, nine, 10, 11, 12, 13, 14, 15, and preferably 16 N-myristoylation sites (PS00008); at least one amidation site (PS00009); and at least one coiled coil domain.

Activating mutations of the kras oncogene are common in both lung and colon tumors. Mutations in kras result in increased cellular proliferation, presumably mediated through effectors of ras function. 16836 appears to be a novel ras effector. An association of 16836 with the ras pathway is further supported by its increased expression in tumors (e.g., lung, breast, and colon tumors) and particularly in tumors with activating kras mutations. Expression of 16836 may be a required component of the kras signaling pathway in tumor cells, and increases in the levels of 16836 may contribute to the process of tumorigenesis.

As the 16836 polypeptides of the invention may modulate 16836-mediated activities, they may be useful as of for developing novel diagnostic and therapeutic agents for 16836-mediated or related disorders, as described below.

As used herein, a "16836 activity", "biological activity of 16836" or "functional activity of 16836," refers to an activity exerted by a 16836 protein, polypeptide or nucleic acid molecule. For example, a 16836 activity can be an activity exerted by 16836 in a physiological milieu on, e.g., a 16836-responsive cell or on a 16836 substrate, e.g., a protein substrate. A 16836 activity can be determined in vivo or in vitro. In one embodiment, a 16836 activity is a direct activity, such as an association with a 16836 target molecule. A "target molecule" or "binding partner" is a molecule with which a 16836 protein binds or interacts in nature, e.g., a phosphatidylinositol or a ras protein.

A 16836 activity can also be an indirect activity, e.g., a cellular signaling activity mediated by interaction of the 16836 protein with a 16836 ligand. Based on the above-described sequence similarities as well as 16836 expression patterns, the 16836 molecules of the present invention are predicted to have similar biological activities as phospholipase C family members and ras association proteins. Members of the phospholipase C family play important roles in signal transduction. An activated PLC is capable of catalyzing the hydrolysis of $PIP_2$, a minor component of the plasma membrane, to produce DAG and $IP_3$. $IP_3$ causes the release of calcium from intracellular stores and increases the influx of calcium from the extracellular fluid. The calcium ions directly regulate target enzymes and indirectly affect other enzymes by functioning as a second messenger and interacting with calcium-binding proteins, such as troponin C and calmodulin. For example, calcium ions regulate muscle contraction, glycogen breakdown and exocytosis. DAG, a product of hydrolysis by PI-PLCs, acts as a second messenger by activating protein kinase C. Activated protein kinase C phosphorylates a great number of intracellular proteins at the serine and threonine residues and modulates different signaling pathways. For example, the phosphorylation of glycogen synthase by protein kinase C stops the synthesis of glycogen. Moreover, protein kinase C controls cell division and proliferation. Both pathways are part of transmembrane signal transduction mechanisms, which regulate cellular processes, which include secretion, neural activity, metabolism, differentiation and proliferation. The presence of an RA domain in 16836 suggests that it is a ras effector, participating in propagating or amplifying cellular proliferation signals transduced by ras.

The 16836 proteins of the present invention can have one or more of the following activities: (1) phospholipid metabolizing activity, e.g., the ability to catalyze hydrolysis of $PIP_2$ to produce DAG and $IP_3$; (2) the ability to associate with ras, e.g., activated ras; (3) the ability to propagate ras-mediated signal transduction; (4) the ability to mediate guanine nucleotide exchange activity; (5) the ability to transduce membrane signals; (6) the ability to modulate proliferation; (7) the ability to modulate differentiation; (8) the ability to modulate secretion; (9) the ability to modulate cell migration; (10) the ability to modulate metabolism; (11) the ability to modulate sensory perception; or (12) the ability to modulate fertilization.

Gene Expression Analysis of 16836

Endogenous human 16836 gene expression was determined using the Perkin-Elmer/ABI 7700 Sequence Detection System which employs TaqMan® technology. Briefly, TaqMan® technology relies on standard RT-PCR with the addition of a third gene-specific oligonucleotide (referred to as a probe) which has a fluorescent dye coupled to its 5' end (typically 6-FAM) and a quenching dye at the 3' end (typically TAMRA). When the fluorescently tagged oligonucleotide is intact, the fluorescent signal from the 5' dye is quenched. As PCR proceeds, the 5' to 3' nucleolytic activity of taq polymerase digests the labeled primer, producing a free nucleotide labeled with 6-FAM, which is now detected as a fluorescent signal. The PCR cycle where fluorescence is first released and detected is directly proportional to the starting amount of the gene of interest in the test sample, thus providing a way of quantitating the initial template concentration. Samples can be internally controlled by the addition of a second set of primers/probe specific for a housekeeping gene such as GAPDH which has been labeled with a different fluorophore on the 5' end (typically VIC).

To determine the level of 16836 in various human tissues a primer/probe set was designed using Primer Express (Perkin-Elmer) software and primary cDNA sequence information. Total RNA was prepared from a series of human tissues using an RNeasy kit from Qiagen. First strand cDNA was prepared from one ug total RNA using an oligo dT primer and Superscript II reverse transcriptase (Gibco/BRL). cDNA obtained from approximately 50 ng total RNA was used per TaqMan® reaction.

Normal tissues tested included the human tissues including bone cells (e.g., osteoclasts and osteoblasts), liver, fetal liver, brain, trachea, skeletal muscle, heart, thyroid, skin, testis, breast, and placenta, among others. 16836 mRNA expression in this TaqMan® tissue panel revealed that 16836 was found primarily in osteoclasts, testis, brain, skeletal muscle, breast, heart and fetal liver.

As assessed using a lung panel, increased expression of 16836 was seen in lung tumors (small cell carcinoma (SCC) and adenocarcinoma (AC)) when compared to normal lung tissue. Association of elevated expression of 16836 with activating mutations of kras was found in both lung tumor samples and tumor cell lines derived from the breast, colon, and lung.

In a panel comprising normal and tumor tissues from the breast, lung, colon, and liver, increased expression of 16836 was seen in the tumor tissues, especially tumors of the breast, lung, and colon. A breast panel further substantiated upregulation of 16836 expression in breast tumor samples as compared to normal breast tissues. Another panel comprising transformed cell lines, including human breast cancer cell lines (MCF-7, ZR75, T47D, and MDA), human colon cancer cell lines (DLD-1, SW480, SW620, HCT116, HT 29, and Colo205), and human lung cancer cell lines (NCI-H125 and A549) revealed expression of 16836 in these cell lines.

The incidence of tumor associated expression of 16836 in tumors of the colon, breast, and lung was evaluated by in situ hybridization. Moderate expression of 16836 was detected in colonic tumor cells (expression in 0/2 normal samples; expression in 2/3 tumor samples; and expression in 0/2 metastases samples). Slightly positive expression was seen focally in normal epithelium in one breast tumor sample (expression in 0/2 normal samples; and expression in normal epithelium in 1/4 tumor samples). Moderate expression was seen in inflammatory cells of lung tumor samples (expression in 0/2 normal samples; and expression in 2/4 tumor samples).

Tissue Distribution of 16836 mRNA by Northern Analysis

Northern blot hybridizations with various RNA samples can be performed under standard conditions and washed under stringent conditions, i.e., 0.2×SSC at 65° C. A DNA probe corresponding to all or a portion of the 16836 cDNA (SEQ ID NO:66) can be used. The DNA was radioactively labeled with $^{32}$P-dCTP using the Prime-It Kit (Stratagene, La Jolla, Calif.) according to the instructions of the supplier. Filters containing mRNA from mouse hematopoietic and endocrine tissues, and cancer cell lines (Clontech, Palo Alto, Calif.) can be probed in ExpressHyb hybridization solution (Clontech) and washed at high stringency according to manufacturer's recommendations.

Northern blot hybridizations were performed using a labeled 16836 probe and RNA samples from various lung tumors and tumor cell lines. A 16836 transcript greater than 7.5 kb in size was detected in some of these samples. The results were as follows: NHBE (negative); A549 (very strong positive); NCI-H69 (negative); NCI-H125 (strong positive); NCI-H322 (positive); and NCI-H460 (positive).

As seen by these results, 16836 molecules of the invention have been found to be expression in bone cells (e.g., osteoclasts), testis, brain, skeletal muscle, breast, heart, lung, colon, fetal liver and tumor samples. Accordingly, the molecules of the invention may mediate disorders involving aberrant activities of those cells, e.g., bone disorders, testicular disorders, cardiovascular disorders, skeletal muscle disorders, lung disorders, colon disorders, cellular proliferative and/or differentiative disorders or immune disorders as described in more detail below.

Human 46867

The present invention is based, at least in part, on the discovery of arginine methyltransferase family members, referred to herein as "transferase" or "46867" nucleic acid and protein molecules. The transferase molecules of the present invention are useful as modulating agents, or as targets for developing modulating agents to regulate a variety of cellular processes facilitated by transferase molecules. Accordingly, in one aspect, this invention provides isolated nucleic acid molecules encoding transferase proteins or biologically active portions thereof, as well as nucleic acid fragments suitable as primers or hybridization probes for the detection of transferase-encoding nucleic acids.

The nucleotide sequence of the isolated human transferase cDNA and the predicted amino acid sequence of the human transferase polypeptide correspond to the sequences shown in SEQ ID NO:75, and SEQ ID NO:76 respectively. The human transferase gene is approximately 2379 nucleotides in length, encodes a protein having a molecular weight of approximately 76 kD and which is approximately 693 amino acid residues in length.

The present invention is based, at least in part, on the discovery of novel transferase family members, referred to herein as "transferase" or "46867" nucleic acid and protein molecules. The 46867 polypeptide has similarities to arginine methyltransferase, and thus the 46867 polypeptides are expected to function in the arginine methylation of proteins. Arginine-methylation is a postraslational modification reaction associated with cellular proliferation. Further, the 46867 was found to be expressed in clinical tumor cells of the breast, lung, and colon in particular and upregulated in 46867 in the $APC^{min}$ adenoma model, thus, without being bound by theory, the 46867 protein is expected to play a role in breast, lung, and colon tumorigenesis and metastases.

In general, transferases catalyze the transfer of one molecular group from one molecule to another. For instance, such molecular groups include phosphate, amino, methyl, acetyl, acyl, phosphatidyl, phosphoribosyl, among other groups. One particular transferase, protein arginine methyltransferase, transfers a methyl group from S-adenosylmethionine to the guanidino group nitrogen atoms in arginine residues of specific proteins.

This enzyme modifies a number of generally nuclear or nucleolar protein substrates in vitro, including histones and proteins involved in RNA metabolism such as hnRNPA1, fibrillarin, and nucleolin. Postulated roles for these reactions include signal transduction, nuclear transport, or a direct modulation of nucleic acid interactions. One feasible role for arginine methylation is in facilitating the export of certain hnRNPs out of the nucleus.

Recently the relationship between protein-arginine methylation and cellular proliferation in cancer cell lines has been studied. Cytosolic extracts prepared from several cancer cells (HeLa, HCT-48, A549, and HepG2) incubated with S-adenosyl-L-[methyl-3H]methionine revealed a [methyl-3H]-labeled 20-kDa polypeptide. Similar extracts prepared from normal colon cells did not show any methylation of the 20-kDa protein. This suggests that the 20-kDa arginine-methylation is a posttranslational modification reaction associated with cellular proliferation.

Protein arginine methyltransferase was recently identified to be associated with some proteins in signal transduction pathways. It was found that CARM1 in gene activation experiments behaves like a coactivator, boosting the effect of nuclear receptors and p160 on gene expression. The p160 family of coactivators, SRC-1, GRIP1/TIF2, and p/CIP, mediate transcriptional activation by nuclear hormone receptors. When CARM1 was mutated, disabling is methyl-adding activity, it lost its ability to boost transcription as well. Thus, coactivator-mediated methylation of proteins in the transcription machinery may contribute to transcriptional regulation. Please see Chen, D., et al., (1999) *Science,* 284:2174-2177; Xu, X., et al., (1994) *Mol Cell Endocrinology,* November; 105(2):197-201; Sugimachi, K, et al., (1997) *Hepatogastroenterology,* January-February; 44(13):78-83; Izbicki, J, et al., (1984) *J Cancer Res Clin Oncology,* 108(3):345-50; Kim, S., et al., (1999) *Life Sci* 65(8):737-45, which are incorporated herein by reference.

The transferase molecules of the present invention are predicted to modulate and facilitate cell proliferation, differentiation, motility, and apoptosis. Thus, the transferase molecules of the present invention may play a role in cellular growth signaling mechanisms. As used herein, the term "cellular growth signaling mechanism" includes signal transmissions from cell receptors, e.g., growth factor receptors, which regulate one or more of the following: 1) cell transversal through the cell cycle, 2) cell differentiation, 3) cell migration and patterning, and 4) programmed cell death. Throughout development and in the adult organism, cell fate and activity is determined, in part, by extracellular and intracellular stimuli, e.g., growth factors, angiogenic factors, chemotactic factors, neurotrophic factors, cytokines, and hormones. These stimuli act on their target cells by initiating signal transduction cascades that alter the pattern of gene expression and metabolic activity so as to mediate the appropriate cellular response. The transferase molecules of the present invention are predicted to be involved in the initiation or modulation of cellular signal transduction pathways that modulate cell growth, differentiation, migration and/or apoptosis. Thus, the transferase molecules, by participating in cellular growth signaling mechanisms, may modulate cell behavior and act as therapeutic agents for controlling cellular proliferation, differentiation, migration, and apoptosis.

Altered expression of factors (e.g., a transferase molecule) involved in the regulation of signaling pathways associated with cell growth, differentiation, migration, and apoptosis can lead to perturbed cellular proliferation, which in turn can lead to cellular proliferative and/or differentiative disorders. As used herein, a "cellular proliferative disorder" includes a disorder, disease, or condition characterized by a deregulated, e.g., upregulated or downregulated, growth response. As used herein, a "cellular differentiative disorder" includes a disorder, disease, or condition characterized by aberrant cellular differentiation. Thus, the transferase molecules can act as novel diagnostic targets and therapeutic agents for controlling cellular proliferative and/or differentiative disorders. Examples of cellular proliferative and/or differentiative disorders include cancer, e.g., carcinoma, sarcoma, or leukemia; and disorders involving aberrant angiogenesis and/or vascularity, e.g., tumor angiogenesis and metastasis, diabetic retinopathy, macular degeneration, psoriasis, endometriosis, Grave's disease, ischemic disease (e.g., atherosclerosis), and chronic inflammatory diseases (e.g., rheumatoid arthritis).

The term "family" when referring to the protein and nucleic acid molecules of the invention is intended to mean two or more proteins or nucleic acid molecules having a common structural domain or motif and having sufficient amino acid or nucleotide sequence homology as defined herein. Such family members can be naturally or non-naturally occurring and can be from either the same or different species. For example, a family can contain a first protein of human origin as well as other distinct proteins of human origin, or alternatively, can contain homologues of non-human origin, e.g., rat or mouse proteins. Members of a family can also have common functional characteristics.

For example, members of the transferase family of proteins include at least one arginine methyltransferase domain in the protein molecule or the nucleic acid molecule encoding the protein molecule.

In another preferred embodiment, a member of this novel subfamily of transferase proteins has at least one transferase domain which includes at least about 102-311 amino acid residues and has at least about 30-35% identity with the transferase domain of human transferase (e.g., residues 40-336 of SEQ ID NO:76; the identified ProDom consensus amino acid sequence is depicted in SEQ ID NO:78.). Preferably, the transferase domain includes at least about 130-280 amino acid residues, or about 160-240 amino acid residues, or 190-210 amino acid residues, and has at least 35-55% identity, preferably about 55-65%, more preferably about 65-75%, even more preferably from about 75-85%, and most preferably from about 85-95% identity with the corresponding transferase domain of human transferase (e.g., residues 40-336 of SEQ ID NO:76). The identified ProDom consensus amino acid sequence is depicted in SEQ ID NO:78.

Accordingly, transferase proteins having at least 30-35% identity, preferably about 35-55%, more preferably about 55-65%, or about 65-75% identity, even more preferably 75-85% and most preferably 85-95% with a corresponding transferase domain of human transferase are within the scope of the invention.

A plasmid containing the nucleotide sequence encoding human 46867 (clone "Fbh46867FL") was deposited with American Type Culture Collection (ATCC), 10801 University Boulevard, Manassas, Va. 20110-2209, on Apr. 11, 2000 and assigned Accession Number PTA-1681. This deposit will be maintained under the terms of the Budapest Treaty on the International Recognition of the Deposit of Microorganisms for the Purposes of Patent Procedure. This deposit was made merely as a convenience for those of skill in the art and is not an admission that a deposit is required under 35 U.S.C. §112.

To identify the presence of a transferase domain in a transferase protein, and make the determination that a protein of interest has a particular profile, the amino acid sequence of the protein is searched against a database of HMMs (e.g., the Pfam database, release 2.1) using the default parameters. For example, the hmmsf program, which is available as part of the HMMER package of search programs, is a family specific default program for MILPAT0063 and a score of 15 is the default threshold score for determining a hit. Alternatively, the threshold score for determining a hit can be lowered (e.g., to 8 bits). A description of the Pfam database can be found in Sonhammer et al. (1997) *Proteins* 28(3):405-420 and a detailed description of HMMs can be found, for example, in Gribskov et al. (1990) *Meth. Enzymol.* 183:146-159; Gribskov et al. (1987) *Proc. Natl. Acad. Sci. USA* 84:4355-4358; Krogh et al. (1994) *J. Mol. Biol.* 235:1501-1531; and Stultz et al. (1993) *Protein Sci.* 2:305-314, the contents of which are incorporated herein by reference.

Post-translational modification sites are identified by using Prosite software, Release 12.2 of February 1995.

Isolated proteins of the present invention, preferably transferase proteins, have an amino acid sequence sufficiently homologous to the amino acid sequence of SEQ ID NO:76, or are encoded by a nucleotide sequence sufficiently homologous to SEQ ID NO:75. As used herein, the term "sufficiently homologous" refers to a first amino acid or nucleotide sequence which contains a sufficient or minimum number of identical or equivalent (e.g., an amino acid residue which has a similar side chain) amino acid residues or nucleotides to a second amino acid or nucleotide sequence such that the first and second amino acid or nucleotide sequences share common structural domains or motifs and/or a common functional activity. For example, amino acid or nucleotide sequences which share common structural domains have at least 50% homology, preferably 60% homology, more preferably 70%-80%, and even more preferably 90-95% homology across the amino acid sequences of the domains and contain at least one and preferably two structural domains or motifs, are defined herein as sufficiently homologous. Furthermore, amino acid or nucleotide sequences which share at least 50%, preferably 60%, more preferably 70-80%, or 90-95% homology and share a common functional activity are defined herein as sufficiently homologous.

As used interchangeably herein, a "transferase activity", "biological activity of transferase" or "functional activity of transferase", refers to an activity exerted by a transferase protein, polypeptide or nucleic acid molecule on a transferase responsive cell or on a transferase protein substrate, as determined in vivo or in vitro, according to standard techniques. In one embodiment, a transferase activity is a direct activity, such as an association with a transferase target molecule. As used herein, a "target molecule" or "binding partner" is a molecule with which a transferase protein binds or interacts in nature, such that transferase-mediated function is achieved. A transferase target molecule can be a non-transferase molecule or a transferase protein or polypeptide of the present invention. In an exemplary embodiment, a transferase target molecule is a transferase substrate or receptor. A transferase activity can also be an indirect activity, such as a cellular signaling activity mediated by interaction of the transferase protein with a transferase substrate or receptor. Preferably, a transferase activity is the ability to act as a growth regulatory factor and to modulate cell proliferation, differentiation, migration, apoptosis, and/or angiogenesis.

Accordingly, another embodiment of the invention features isolated transferase proteins and polypeptides having a transferase activity. Preferred proteins are transferase proteins including at least one transferase domain, and, preferably, having a transferase activity. Further preferred proteins include at least one transferase domain, and are, preferably, encoded by a nucleic acid molecule having a nucleotide sequence which hybridizes under stringent hybridization conditions to a nucleic acid molecule comprising the nucleotide sequence of SEQ ID NO:75.

In one embodiment, a transferase nucleic acid molecule of the invention is at least 50%, 55%, 60%, 65%, 70%, 75%, 80%, 85%, 90%, 95%, 98%, or more identical to the nucleotide sequence (e.g., to the entire length of the nucleotide sequence) shown in SEQ ID NO:75, or a complement thereof.

In another embodiment, the isolated nucleic acid molecule includes the nucleotide sequence shown SEQ ID NO:75, SEQ ID NO:77, or a complement thereof. In another embodiment, the nucleic acid molecule includes at least one fragment of at least 425 nucleotides (e.g., 425 contiguous nucleotides) of at least one nucleotide sequence of SEQ ID NO:75, SEQ ID NO:77 or a complement thereof.

In still another embodiment, a transferase nucleic acid molecule includes a nucleotide sequence encoding a protein having an amino acid sequence sufficiently homologous to the amino acid sequence of SEQ ID NO:76. In one embodiment, a transferase nucleic acid molecule includes a nucleotide sequence encoding a protein having an amino acid sequence at least 50%, 55%, 60%, 65%, 70%, 75%, 80%, 85%, 90%, 95%, 98% or more identical to the entire length of the amino acid sequence of SEQ ID NO:76.

In another embodiment, an isolated nucleic acid molecule encodes the amino acid sequence of human transferase. In yet another embodiment, the nucleic acid molecule includes a nucleotide sequence encoding a protein having the amino acid sequence of SEQ ID NO:76.

In yet another embodiment, the nucleic acid molecule is, in length, at least 425 nucleotides (e.g., 425 contiguous nucleotides) of at least one nucleotide sequence of SEQ ID NO:75, SEQ ID NO:77 or a complement thereof and encodes a protein having a transferase activity as described herein.

Another embodiment of the invention features nucleic acid molecules, preferably transferase nucleic acid molecules, which specifically detect transferase nucleic acid molecules relative to nucleic acid molecules encoding non-transferase proteins. For example, in one embodiment, such a nucleic acid molecule is at least 50, 60, 70, 80, 90, 100, 150, 200, 300, 400, 500, 549, 549-600, 600-650, 650-700, 700-750, 750-800, 800-850, 850-900, 900-950, 950-1000, 1000-1100, 1100-1200, 1200-1300, 1300-1400, 1400-1500, 1500-1600, 1600-1700, 1700-1800, 1800-1900, 1900-2000, 2000-2100, 2100-2200, 2200-2300, 2300-2350 or more nucleotides in length and hybridizes under stringent conditions to a nucleic acid molecule comprising the nucleotide sequence shown in SEQ ID NO:75 or SEQ ID NO:77.

In other embodiments, the nucleic acid molecule encodes a naturally occurring allelic variant of a polypeptide comprising the amino acid sequence of SEQ ID NO:76, wherein the nucleic acid molecule hybridizes to a nucleic acid molecule comprising SEQ ID NO:75 or SEQ ID NO:77 under stringent conditions.

Another embodiment of the invention provides an isolated nucleic acid molecule which is antisense to a transferase nucleic acid molecule, e.g., the coding strand of a transferase nucleic acid molecule.

In a related aspect, the invention provides a vector comprising a transferase nucleic acid molecule. In certain embodiments, the vector is a recombinant expression vector. In another embodiment, the invention provides a host cell containing a vector of the invention. In yet another embodiment, the invention provides a host cell containing a nucleic acid molecule of the invention.

The invention also provides a method for producing a protein, preferably a transferase protein, by culturing in a suitable medium, a host cell, e.g., a mammalian host cell, such as a non-human mammalian cell, of the invention containing a recombinant expression vector, such that the protein is produced.

Another aspect of this invention features isolated or recombinant transferase proteins and polypeptides. In one embodiment, the isolated transferase protein includes at least one transferase domain or an arginine methyltransferase domain.

In other embodiments, the transferase protein of the invention has an amino acid sequence at least about 50%, 55%, 60%, 65%, 70%, 75%, 80%, 85%, 90%, 95%, 98% or more identical to the amino acid sequence of SEQ ID NO:76. In another embodiment, the transferase protein includes at least one transferase domain or an arginine methyltransferase domain, and has an amino acid sequence at least about 50%, 55%, 60%, 65%, 70%, 75%, 80%, 85%, 90%, 95%, 98% or more identical to the amino acid sequence of SEQ ID NO:76.

In another embodiment, the transferase proteins of the invention play a role in cell growth and cell processes facilitated by transferase proteins, e.g., the regulation of cell proliferation, differentiation, migration, and apoptosis.

In other embodiments, the transferase proteins of the invention are encoded by a nucleic acid molecule having a nucleotide sequence which hybridizes under stringent hybridization conditions to a nucleic acid molecule comprising the nucleotide sequence of SEQ ID NO:75 or SEQ ID NO:77.

In a further embodiment, the invention features an isolated transferase protein which is encoded by a nucleic acid molecule consisting of a nucleotide sequence at least about 50%, 55%, 60%, 65%, 70%, 75%, 80%, 85%, 90%, 95%, 98% or more identical to a nucleotide sequence of SEQ ID NO:75, SEQ ID NO:77 or a complement thereof. This invention further features an isolated transferase protein which is encoded by a nucleic acid molecule consisting of a nucleotide sequence which hybridizes under stringent hybridization conditions to a nucleic acid molecule comprising the nucleotide sequence of SEQ ID NO:75, SEQ ID NO:77, or a complement thereof. In still another embodiment, the transferase protein has the amino acid sequence of SEQ ID NO:76.

In another embodiment, the invention features fragments of the protein having the amino acid sequence of SEQ ID NO:76, wherein the fragment comprises at least 15 amino acids (e.g., contiguous amino acids) of the amino acid sequence of SEQ ID NO:76, more preferably the fragment comprises 20, 25, 30, 35, 40, 45, 50, 65, 100, 130, 160-170, 170-180, 180-210, 210-230, 230-250, 250-265, 265-280, 280-300, 300-315, 315-330, 330-350, 350-375, 375-400, 400-420, 420-440, 440-465, 465-485, 485-500, 500-520, 520-540, 540-565, 565-585, 585-600, 600-620, 620-640, 640-665, or 665-690 amino acids.

The proteins of the present invention or portions thereof, e.g., biologically active portions thereof, can be operatively linked to a non-transferase polypeptide (e.g., heterologous amino acid sequences) to form fusion proteins. In addition, the transferase proteins or biologically active portions thereof can be incorporated into pharmaceutical compositions, which optionally include pharmaceutically acceptable carriers.

The invention further features antibodies, such as monoclonal or polyclonal antibodies, that specifically bind proteins of the invention, preferably transferase proteins.

In another aspect, the present invention provides a method for detecting the presence of a transferase nucleic acid molecule, protein or polypeptide in a biological sample by contacting the biological sample with an agent capable of detecting a transferase nucleic acid molecule, protein or polypeptide such that the presence of a transferase nucleic acid molecule, protein or polypeptide is detected in the biological sample.

In another aspect, the present invention provides a method for detecting the presence of transferase activity in a biological sample by contacting the biological sample with an agent capable of detecting an indicator of transferase activity such that the presence of transferase activity is detected in the biological sample.

In another aspect, the invention provides a method for modulating transferase activity comprising contacting a cell capable of expressing transferase with an agent that modulates transferase activity such that transferase activity in the cell is modulated. In one embodiment, the agent inhibits transferase activity. In another embodiment, the agent stimulates transferase activity. In one embodiment, the agent is an antibody that specifically binds to a transferase protein. In another embodiment, the agent modulates expression of transferase by modulating transcription of a transferase gene or translation of a transferase mRNA. In yet another embodiment, the agent is a nucleic acid molecule having a nucleotide sequence that is antisense to the coding strand of a transferase mRNA or a transferase gene.

Another aspect of the present invention features methods to treat a subject having a disorder characterized by aberrant transferase protein or nucleic acid expression or activity by administering an agent which is a transferase modulator to the subject. In one embodiment, the transferase modulator is a transferase protein. In another embodiment the transferase modulator is a transferase nucleic acid molecule. In yet another embodiment, the transferase modulator is a peptide, peptidomimetic, or other small molecule.

The present invention also provides a diagnostic assay for identifying the presence or absence of a genetic alteration characterized by at least one of (i) aberrant modification or mutation of a gene encoding a transferase protein; (ii) misregulation of the gene; and (iii) aberrant post-translational modification of a transferase protein, wherein a wild-type form of the gene encodes a protein with a transferase activity.

In another aspect the invention provides a method for identifying a compound that binds to or modulates the activity of a transferase protein, by providing an indicator composition comprising a transferase protein having transferase activity, contacting the indicator composition with a test compound, and determining the effect of the test compound on transferase activity in the indicator composition to identify a compound that modulates the activity of a transferase protein.

In preferred embodiments of the methods described above, the 46867 molecule, the transferase activity thereof, or the disorder to be treated is associated with cancer, preferably lung, breast, liver, or colon cancer. Further the biological sample is preferably one that is derived from a subject having cancer or at risk of developing cancer, preferably lung, breast, liver (e.g. metastatic liver) or colon cancer.

Gene Expression Analysis of 46867

TaqMan® real-time quantitative RT-PCR was used to detect the presence of RNA transcript corresponding to human 46867 in several tissues. It was found that the corresponding orthologs of 46867 are expressed in a variety of tissues. Variable expression was found in all xenograph friendly cell lines tested.

Reverse Transcriptase PCR(RT-PCR) was used to detect the presence of RNA transcript corresponding to human 46867 in RNA prepared from tumor and normal tissues. Relative expression levels of the 46867 was assessed in angiogenic tissues. In addition, relative expression levels of the 46867 was assessed in breast, colon, liver and lung cells using TaqMan® PCR and increased expression was found in 4/6 breast tumor cell lines in comparison to a normal breast tissue control; in 3/7 clinical colon tumors in comparison to normal colon tissues and also in liver metastases in comparison to normal liver tissues; and 3/5 adenocarcinoma of lung in comparison to normal lung tissue control. In addition, up regulation was found in colon tumor cell lines in comparison to a normal colon tissue control and liver metastases in comparison to normal liver tissue control. Additonal TaqMan® analyses also demonstrated significant expression levels in osteoclasts, skin, testis fetal liver and fetal heart.

Expression profiling results using in situ hybridization techniques have shown that 46867 mRNA has been detected in human colon, lung, liver and breast tumors.

Expression profiling results using in situ hybridization techniques have also shown elevated expression in murine $APC^{min}$ adenomas. In addition, an mMPG array shows elevated expression in $APC^{min}$ adenomas in comparison to $APC^{min}$ normal small intestine. Further, relative expression levels of the murine 46867 using TaqMan® PCR shows increase expression in later stage $APC^{min}$ in adenoma time course samples.

As seen by these results, 46867 molecules of the invention have been found to be expression in breast cancer samples, colon cancer samples, metastatic liver samples, lung cancer samples, osteoclast samples, skin samples, testicular samples, fetal liver samples and fetal heart samples. Accordingly, the molecules of the invention may mediate disorders involving aberrant activities of those cells, e.g., breast disorders, colon disorders, liver disorders, lung disorders, bone disorders, skin disorders, testicular disorders, cardiovascular disorders and cellular proliferative and/or differentiative disorders as described in more detail below.

Additionally, 46867 molecules have been found to be over-expressed in some tumor cells, where the molecules may be inappropriately propagating either cell proliferation or cell survival signals. As such, 46867 molecules may serve as specific and novel identifiers of such tumor cells. Further, inhibitors of the 46867 molecules are also useful for the treatment of cancer, preferably breast, colon, metastatic liver or lung cancer, and useful as a diagnostic.

Human 21617

The human 21617 sequence (see SEQ ID NO:79 and section below entitled "Identification and Characterization of Human 21617 cDNA"), which is approximately 3624 nucleotides long including untranslated regions, contains a predicted methionine-initiated coding sequence of about 1026 nucleotides, including the termination codon. The coding sequence encodes a 341 amino acid protein (see SEQ ID NO:80 and section below entitled "Identification and Characterization of Human 21617 cDNA"). The human 21617 protein of SEQ ID NO:80 includes an amino-terminal hydrophobic amino acid sequence, consistent with a signal sequence, of about 21 amino acids (from amino acid 1 to about amino acid 21 of SEQ ID NO:80), which upon cleavage results in the production of a mature protein form). This mature protein form is approximately 319 amino acid residues in length (from about amino acid 22 to amino acid 341 of SEQ ID NO:80).

Human 21617 contains the following regions or other structural features: a short chain dehydrogenase domain (PFAM Accession Number PF00106) located at about amino acid residues 37 to 249 of SEQ ID NO:80; a predicted short-chain alcohol dehydrogenase family signature motif (PS00061) located at about amino acid residues 210 to 220 of SEQ ID NO:80; a predicted signal peptide located at about amino acid residues 1 to 21 of SEQ ID NO:80, which when cleaved gives a predicted mature protein of 319 amino acids, from about amino acid residues 22 to 341 of SEQ ID NO:80;_ two dileucine motifs located at about amino acid residues 62 to 63 and 154 to 155 of SEQ ID NO:80;_one predicted glycosaminoglycan attachment site (PS00002) located at about amino acid residues 46 to 49 of SEQ ID NO:80; three predicted Protein Kinase C phosphorylation sites (PS00005) located at about amino acid residues 11 to 13, 176 to 178, and 289 to 291 of SEQ ID NO:80; two predicted Casein Kinase II phosphorylation sites (PS00006) located at about amino acid residues 72 to 75, and 183 to 186 of SEQ ID NO:80; six predicted N-myristoylation sites (PS00008) located at about amino acid residues 43 to 48, 147 to 152, 200 to 205, 235 to 240, 249 to 254, and 316 to 321 of SEQ ID NO:80; and one predicted amidation site (PS00009) located at about amino acid residues 119 to 122 of SEQ ID NO:80.

For general information regarding PFAM identifiers, PS prefix and PF prefix domain identification numbers, refer to Sonnhammer et al. (1997) Protein 28:405-420.

The 21617 protein contains a significant number of structural characteristics in common with members of the short chain dehydrogenase family. The term "family" when referring to the protein and nucleic acid molecules of the invention means two or more proteins or nucleic acid molecules having a common structural domain or motif and having sufficient amino acid or nucleotide sequence homology as defined herein. Such family members can be naturally or non-naturally occurring and can be from either the same or different species. For example, a family can contain a first protein of human origin as well as other distinct proteins of human origin, or alternatively, can contain homologues of non-human origin, e.g., rat or mouse proteins. Members of a family can also have common functional characteristics.

Short chain dehydrogenases (SDRs) are a large and diverse collection of enzymes grouped into a superfamily comprising over 700 different enzymes including isomerases, lyases, and oxidoreductases (Opperman et al. (1999) Enzymology and Molecular Biology of Carbonyl Metabolism, 7 ed., Weiner et al., Plenum Publishers, NY p. 365-371). They are important in metabolism of small molecules, production/removal of biologically important molecules that modulate development and growth, elimination of toxins, and associated physiological processes and pathological conditions. The enzymes of this family cover a wide range of substrate specificities including sugars, steroids, alcohols, prostaglandins, metabolites (e.g., lipids), and aromatic compounds (Opperman et al. (1999), supra, p. 373-377).

Members of the alcohol dehydrogenase and short-chain dehydrogenase/reductase families catalyze the reversible, rate limiting conversion of retinol to retinal, while the oxidation of retinal to retinoic acid is catalyzed by members of the aldehyde dehydrogenase or P450 enzyme families (Deuster et al. (1996), Biochemistry 35:12221-12227). Other SDR/retinol dehydrogenases function in the visual cycle by converting either 11-cis-retinol to 11-cis-retinal or all trans-retinal to all trans-retinol (Simon et al. (1995) J Biol Chem 270:1107-1112). Retinoic acid plays a key role in the regulation of embryonic development, spermatogenesis, and epithelial differentiation (Chambon et al. (1996), FASEB J 10:940-954, and Mangelsdorf et al. (1995), Cell 83:841-850).

Alcohol dehydrogenases play fundamental roles in degradative, synthetic, and detoxification pathways and have been implicated in a variety of developmental processes and pathophysiological disease states. For example, allelic variations of ADH2 and ADH3 appear to influence the susceptibility to alcoholism and alcoholic liver cirrhosis in Asians (Thomasson et al. (1991), Am J Hum Genet. 48:677-681, Chao et al. (1994), Hepatology 19:360-366, and Higuchi et al. (1995), Am J Psychiatry 152:1219-1221).

A short chain dehydrogenase family of proteins is characterized by the presence of at least two domains; the first binds a coenzyme, such as NAD or NADP, and the second binds substrate. Sequence of the coenzyme domain does not appear to be conserved among dehydrogenases. The second domain determines substrate specificity and contains amino acids involved in catalysis.

Short-chain dehydrogenases/reductases (SDRs) typically function as dimers or tetramers. The subunits are composed of approximately 250 to 300 amino acid residues and include an N-terminal co-enzyme binding motif having the sequence G-X-X-X-G-X-G, and an active-site motif having the sequence Y-X-X-K (Opperman et al. (1999) Enzymology and Molecular Biology of Carbonyl Metabolism 7 ed. Weiner et al., Plenum Publishers, NY p. 373-377). Although identity between different SDR members is at the 15% to 30% level, three-dimensional structures thus far analyzed reveal a highly similar conformation consisting of a single subunit that includes seven to eight 1-strands.

Members of short chain dehydrogenase family include alcohol dehydrogenase, 3-β-hydroxysteroid dehydrogenase, estradiol 17-β-dehydrogenase, retinal dehydrogenase, and NADPH-dependent carbonyl reductase. Thus, this family includes enzymes critical for the proper function of many physiological systems, including metabolism (e.g., alcohol metabolism, steroid metabolism, and the metabolism of toxins), and cellular proliferation and differentiation.

A 21617 polypeptide can include a "short chain dehydrogenase domain" or regions homologous with a "short chain dehydrogenase domain".

As used herein, the terms "short chain dehydrogenase domain" or "dehydrogenase" includes an amino acid sequence of about 100 to 300 amino acid residues in length, having a bit score for the alignment of the sequence to the short chain dehydrogenase domain profile (PFAM HMM) of at least 70. Preferably, a short chain dehydrogenase domain includes at least about 140 to 280 amino acids, more preferably about 200 to 220 amino acid residues, and has a bit score for the alignment of the sequence to the short chain dehydrogenase domain (HMM) of at least 100, 125, 135, or greater. The short chain dehydrogenase domain (HMM) has been assigned the PFAM Accession Number PF00106.

In a preferred embodiment 21617 polypeptide or protein has a "short chain dehydrogenase domain" or a region which includes at least about 100 to 300, more preferably about 140 to 280, or 200 to 220 amino acid residues and has at least about 50%, 60%, 70% 80% 90% 95%, 98%, 99%, or 100% homology with a "short chain dehydrogenase domain", e.g., the short chain dehydrogenase domain of human 21617 (e.g., residues 37 to 249 of SEQ ID NO:80).

To identify the presence of a "short chain dehydrogenase" domain in a 21617 protein sequence, and make the determination that a polypeptide or protein of interest has a particular profile, the amino acid sequence of the protein can be searched against the PFAM database of HMMs (e.g., the PFAM database, release 2.1) using the default parameters. For example, the hmmsf program, which is available as part of the HMMER package of search programs, is a family specific default program for MILPAT0063 and a score of 15 is the default threshold score for determining a hit. Alternatively, the threshold score for determining a hit can be lowered (e.g., to 8 bits). A description of the PFAM database can be found in Sonhammer et al. (1997), Proteins 28(3):405-420, and a detailed description of HMMs can be found, for example, in Gribskov et al. (1990), Meth. Enzymol. 183:146-159; Gribskov et al. (1987), Proc. Natl. Acad. Sci. USA 84:4355-4358; Krogh et al. (1994), J. Mol. Biol. 235:1501-1531; and Stultz et al. (1993), Protein Sci. 2:305-314, the contents of which are incorporated herein by reference. A search was performed against the PFAM HMM database resulting in the identification of a "short chain dehydrogenase" domain in the amino acid sequence of human 21617 located at about amino acid residues 37 to 249 of SEQ ID NO:80 (the identified Pfam "short chain dehydrogenase" domain consensus amino acid sequence of human 21617 corresponds to SEQ ID NO:85).

In some embodiments, a 21617 protein includes at least one dehydrogenase family signature motif. As used herein, a "dehydrogenase family signature motif" includes a sequence of at least eleven amino acid residues defined by the sequence: [LIVSPADNK]-X(12)-Y-[PSTAGNCV][STAG-NQCIVM]-[STAGC]-K-{PC}-[SAGFYR]-[LIVM-STAGD]-X(2)-[LIVMFYW]-X(3)-[LIVMFYWGAPTHQ]-[GSACQRHM]. A dehydrogenase family signature motif, as defined, can be involved in the oxidation of a chemical group, e.g., an alcohol group (C—OH), or the reduction of a chemical group, e.g., a carbonyl group (C=O). A dehydrogenase family signature motif can include 16, 24, and even 29 amino acid residues. The dehydrogenase family signature motif has been given the PROSITE Accession Number PS00061.

In preferred embodiments, a 21617 polypeptide or protein has at least one dehydrogenase family signature motif, or a region which includes at least 11 amino acid residues and has at least 70%, 80%, 90%, or 100% homology with a "dehydrogenase family signature motif", e.g., dehydrogenase family signature motif of human 21617, e.g., about amino acid residues 210 to 220 of SEQ ID NO:80.

In some embodiments, a 21617 molecule can further include a signal sequence. As used herein, a "signal peptide" or "signal sequence" refers to a peptide of about 15 to 50, preferably about 20 to 40, more preferably, 21 amino acid residues in length which occurs at the N-terminus of secretory and integral membrane proteins and which contains a majority of hydrophobic amino acid residues. For example, a signal sequence contains at least about 15 to 50, preferably about 20 to 40, more preferably, 21 amino acid residues, and has at least about 40-70%, preferably about 50-65%, and more preferably about 55-60% hydrophobic amino acid residues (e.g., alanine, valine, leucine, isoleucine, phenylalanine, tyrosine, tryptophan, or proline). Such a "signal sequence", also referred to in the art as a "signal peptide", serves to direct a protein containing such a sequence to a lipid bilayer. For example, in one embodiment, a 21617 protein contains a signal sequence located at about amino acid residues 1 to 21 of SEQ ID NO:80. The "signal sequence" is cleaved during processing of the mature protein. The mature 21617 protein corresponds to about amino acid residues 23 to 341 of SEQ ID NO:80.

In preferred embodiments, a 21617 polypeptide or protein has at least one predicted signal sequence, or a region which includes at least 15, 18, 20, or even 21 amino acid residues and has at least 70%, 80%, 90%, or 100% homology with a "signal sequence", e.g., a signal sequence of human 21617, e.g., about amino acid residues 1 to 21 of SEQ ID NO:80.

A 21617 family member can include at least one short chain dehydrogenase domain. Furthermore, a 21617 family member can include at least one dehydrogenase family signature motif; at least one signal sequence; at least one, two, preferably three protein kinase C phosphorylation sites; at least one, preferably two casein kinase II phosphorylation sites; at least one, two, three, four, five, preferably six N-myristylation sites; and at least one amidation site.

21617 polypeptides of the invention include fragments which include: all or part of a hydrophobic sequence, e.g., the sequence from about 1 to 20, from about 191 to 203, and from about 293 to 310 of SEQ ID NO:80; all or part of a hydrophilic sequence, e.g., the sequence of from about 68 to 77, from about 222 to 236, and from about 325 to 340 of SEQ ID NO:80.

As the 21617 polypeptides of the invention may modulate 21617-mediated activities, they may be useful as of for developing novel diagnostic and therapeutic agents for 21617-mediated or related disorders, as described below.

As used herein, a "21617 activity", "biological activity of 21617" or "functional activity of 21617", refers to an activity exerted by a 21617 protein, polypeptide or nucleic acid molecule. For example, a 21617 activity can be an activity exerted by 21617 in a physiological milieu on, e.g., a 21617-responsive cell or on a 21617 substrate, e.g., a small molecule (e.g. a steroid molecule or a toxin) or a protein. A 21617 activity can be determined in vivo or in vitro. In one embodiment, a 21617 activity is a direct activity, such as an association with a 21617 target molecule. A "target molecule" or "binding partner" is a molecule with which a 21617 protein binds or interacts in nature. In an exemplary embodiment, 21617 is an enzyme that oxidizes an alcohol group or reduces a carbonyl group found in a substrate.

A 21617 activity can also be an indirect activity, e.g., a cellular signaling activity mediated by interaction of a 21617 substrate with a receptor. The features of the 21617 molecules of the present invention can provide similar biological activities as short chain dehydrogenase family members. For example, the 21617 proteins of the present invention can have one or more of the following activities: (1) steroid biosynthesis or metabolism (breakdown); (2) developmental changes associated with steroid biosynthesis or metabolism (e.g., sex trait development); (3) metabolism or removal of natural or xenobiotic substances (e.g., ethanol, toxins, etc.); or (4) cellular proliferation or differentiation.

Furthermore, the 21617 molecules of the invention can be expected to function in the tissues where they are expressed, e.g., colon, breast, lung, cervix, ovary, liver, kidney, endothelial cells, and tumor tissue derived thereof. Thus, the 21617 molecules can act as novel diagnostic targets and therapeutic agents for controlling metabolic disorders, e.g., involving the metabolism of small molecules (e.g., steroids or alcohols), proliferation and differentiation disorders, e.g., cancer (e.g., colon, colorectal, breast, lung, cervical, ovarian or liver cancer), kidney disorders, or endothelial cell disorders.

Identification and Characterization of Human 21617 cDNA

The human 21617 nucleic acid sequence is recited as follows:

```
                                          (SEQ ID NO: 79)
TAGTCTAACTCGCGGCTGTCACCGCCACTGCAGCGGAGCCGGCCGGCCGG

GCGCTGCGGGACGGGCGGGCGGCTGCCGGCAGGAGGCGCCGAGCCGGGTG

ACTGCCGCGGCGGGCACAGTCCGGGGCCACAGCGCCGAGCCCGGGCGGGA

GTGGCCCCGCGCAGGCAGGGAGCGGCGCCGCGCACTCCAACCCGGCGGGC

ACCTCGGGGCGGGCGCGGGCGCAGCCTTCTCGTCCCGGCCTCTGTGAC

AAGCGCCCCGGAGCCGGGAGCCCGATTGCCGGGCTCGGGGTGGGCGCGGA

CGCAGGCACTGGGCTCGTGCGGGCCCCGGGCGTCGCGATGAACATCGTG

GTGGAGTTCTTCGTGGTCACTTTCAAAGTGCTCTGGGCGTTCGTGCTGGC

CGCGGCGCGCTGGCTGGTGCGGCCCAAGGAGAAGAGCGTGGCGGGCCAGG

TGTGCCTCATCACCGGCGCCGGCAGCGGCCTGGGCCGCCTCTTCGCGCTG
```

```
-continued
GAGTTCGCCCGGCGTCGGGCGCTGCTGGTGCTGTGGGACATCAACACGCA
AAGCAACGAGGAGACGGCTGGCATGGTGCGCCACATCTACCGCGACCTGG
AGGCGGCCGACGCCGCTGCGCTGCAAGCTGGGAATGGTGAGGAAGAAATT
CTGCCCCACTGTAACTTGCAGGTTTTTACCTACACCTGTGACGTGGGGAA
GAGGGAGAACGTCTACCTGACGGCTGAAAGAGTCCGCAAGGAGGTTGGCG
AAGTCTCAGTCCTGGTCAATAATGCTGGTGTGGTCTCTGGGCATCACCTT
CTGGAATGTCCTGATGAGCTCATTGAGAGAACCATGATGGTCAATTGCCA
TGCACACTTCTGGACCACTAAGGCTTTTCTTCCTACGATGCTGGAGATTA
ATCATGGTCATATTGTGACAGTTGCAAGTTCCTTGGGATTGTTCAGTACT
GCCGGAGTTGAGGATTACTGTGCCAGTAAATTTGGAGTTGTGGGTTTTCA
TGAATCCCTGAGCCATGAACTAAAGGCTGCTGAAAAGGATGGAATTAAAA
CAACCTTGGTTTGCCCTTATCTTGTAGACACTGGCATGTTCAGAGGCTGC
CGAATCAGGAAAGAAATTGAGCCTTTTCTGCCACCTCTGAAGCCTGATTA
CTGTGTGAAGCAGGCCATGAAGGCCATCCTCACTGACCAGCCCATGATCT
GCACTCCCCGCCTCATGTACATCGTGACCTTCATGAAGAGCATCCTACCA
TTTGAAGCAGTTGTGTGCATGTATCGGTTCCTAGGAGCGGACAAGTGTAT
GTACCCCTTTATTGCTCAAAGAAAGCAAGCCACAAACAATAATGAAGCAA
AAAATGGAATCTAAGAATCTTTTTGTATGGAATATTACTTCTATCAGAAG
ATGATCAAGATGTTTCAGTCCAGTGCACATCAGCATTGCTGACATTTTAT
GGATTCTAAACTTGTGTTGTTTCTTTTTAAATCAACTTTTTAAAAAAAT
AAAGTGTAAATTAACCGACTAGAGTACTTGGAAAATGTGATCAGTACAAG
TGAACTTAGGTTGTTGCCAACAGGGTCCTTTTAGGCAGAACCCAGAAACC
AGTCAAATCTGTAGAGAAGCAGTGTGACATCTTCAGGTTACCATTATTTT
TTAATGAGCAGGAAGTCTAGAAATGATAACTAGACTGTATGTTTCATGTG
TGTGATTTTTCAGAATTCCCAGAGTTTACTCATTCTTGTTATTAAACTCT
AGCCAGTTGACATCTTCGCAATTTCAAGGACTGATAGTGCTGTATTTTCT
CACGTTTTCTAAGTTTCCGTTTTGCAAGGCCTAGGTGACTTTTTCATGGT
GTTTGTATGTTTAGCTCTTTTGAAAAGGAATTTTGAAATCTCCATCAACT
GAAGTAAATGATGTCTGAGTGTTACAGTWAAGGTGACCAAGTCTCTTTCT
TAAAGTCACAATGACTAAAGTATTAGTTGAATTTTTTTTTTTTTTTGA
TGGAGTCTCGCTCTGTCACCAGGCTGGAGTGCAGTAGCACAATCACGGCT
CACTGCAATCTCTGCCTCCCRGTTTCAAGTGATTCTGCTGTCTCAGCCTC
CCAAGTAGCTCGGACTACAGGCATGCGCCACCACGCCCAGCTAATTTTTG
TATTTTTAGTAGAGACGGGGTTTCACCATGTTGGTCAGGATGGTCTCCAT
CTCTTGACATTGTGATCCACCTGCCTCGGCCTCCCAAAGTGCTGGGATTA
CAGGCATGAGCCACTGCACCCAGCCTTGAATTTTTAATTTTATCTCTGAT
ATACTTCATTAAGTGTCTGGAGACCTAATTATCCTAAAAGATCATACATT
TTCTACCTATGAATTTTGCTGCATACAGAAAGTGCCCTTTCCTCAGGAAG
TTGCTGTGTTTCATTTCTTTGGATGGACTCTTATCTAGAATACATAGCAG
CTCTGCAAAGAAACAGTTTTTAAAAATGGGAACTTCTACATTGAAAAGTC
CCCATTTTTGTGCCAACTATGATTAGTGAGAGGAAGAAATCTTATTCTAT
GGCATATGTATGGAAGGGTGTAAAGATTCTTTTGAAAGGTTTATTCACAT
TGTAGAACAGCAAATGACATTTTTACAGTATTTTTTTGTAAAGCAAACTA
TTTTGTGCCTTGAATTTGGTATATGTGTATTAGTGAAACATTGTAAAGGT
GAACTTCTACCTCTGTATCTAAATGTATACCATCCACTTGTAAATGACTA
TAAACTATTATGTGATTGCTTTTTTTTTTAGAATGTCTTGTTTAAATAGT
GGCCAATGTTTAAGGCTGTTAAAATAAGCCAACTTTTACTAATTGGGGAG
TTTTATAAATGACTGATTAAATTTAAAGAATTAACTTACATGCAATTGTG
TGATTATTAGTTATCAGCAGTGTTGTAAGGAAAATTATTGTGTTTTTTTT
TATGATCATTATCCCACTTTAGGTAAAGAAAAATATTGGAATGGAATAGT
GTTGGGAAACAGACATTAACAACCTAGGGTGCCTGCACTCAAATAGCCGA
TGTTACTGTCCCTAGATTAGAGACTTGATTAAGGGCTTGTTTGTACCAAA
AGTGGGAAACAATGCCATGACCTGTGTTTTAGTTTGGCTGCACCACAGA
TCAAATCTGCACTGTGTCTACATATAGGAAAGGTCCTGGTGTGTGCTAAT
GTTCCCAATGCAGGACTTGAGGAAGAGCTCTGTTATATGTTTCCATTTCT
CTTTATCAAAGATAACCAAACCTTATGGCCCTTATAACAATGGAGGCACT
GGCTGCCTCTTAATTTTCAATCATGGACCTAAAGAAGTACTCTGAAGGGT
CTCAACAATGCCAGGTGGGACAGATATACTCAGAGATTATCCAGGTCTG
CCTCCCAGCGAGCCTGGAGTACACCAGACCCTCCTAGAGAAATCTGTTAT
AATTTAACAACCCACTTATCCACCTTAAAACTGAGGAAAGTCGTCTTTAC
ATCTAATTTTATTCTTGTGTGTTATAACTTAAACCTATTTCTATTTTTGT
TTGTTATTGCCCTTATAAGGGTGTCCATCTCCAAGTTCAATAAACTAATT
CATTTAAAAAAAAAAAAAAAAAAAA.
```

The human 21617 sequence (SEQ ID NO:79) is approximately 3624 nucleotides long. The nucleic acid sequence includes an initiation codon (ATG) and a termination codon (TAA), which are indicated in bold and underscored above. The region between and inclusive of the initiation codon and the termination codon is a methionine-initiated coding sequence of about 1026 nucleotides, including the termination codon (nucleotides 339 to 1364 of SEQ ID NO:79; SEQ ID NO:81). The coding sequence encodes a 341 amino acid protein (SEQ ID NO:80), which is recited as follows:

```
                                            (SEQ ID NO: 80)
MNIVVEFFVVTFKVLWAFVLAAARWLVRPKEKSVAGQVCLITGAGSGLGR

LFALEFARRRALLVLWDINTQSNEETAGMVRHIYRDLEAADAAALQAGNG

EEEILPHCNLQVFTYTCDVGKRENVYLTAERVRKEVGEVSVLVNNAGVVS

GHHLLECPDELIERTMMVNCHAHFWTTKAFLPTMLEINHGHIVTVASSLG

LFSTAGVEDYCASKFGVVGFHESLSHELKAAEKDGIKTTLVCPYLVDTGM

FRGCRIRKEIEPFLPPLKPDYCVKQAMKAILTDQPMICTPRLMYIVTFMK

SILPFEAVVCMYRFLGADKCMYPFIAQRKQATNNNEAKNGI.
```

Tissue Distribution of 21617 mRNA

Endogenous human 21617 or 55562 gene expression can also be determined using the Perkin-Elmer/ABI 7700 Sequence Detection System which employs TaqMan® technology. Briefly, TaqMan® technology relies on standard RT-PCR with the addition of a third gene-specific oligonucleotide (referred to as a probe) which has a fluorescent dye coupled to its 5' end (typically 6-FAM) and a quenching dye at the 3' end (typically TAMRA). When the fluorescently tagged oligonucleotide is intact, the fluorescent signal from the 5' dye is quenched. As PCR proceeds, the 5' to 3' nucleolytic activity of Taq polymerase digests the labeled primer, producing a free nucleotide labeled with 6-FAM, which is now detected as a fluorescent signal. The PCR cycle where fluorescence is first released and detected is directly proportional to the starting amount of the gene of interest in the test sample, thus providing a quantitative measure of the initial template concentration. Samples can be internally controlled by the addition of a second set of primers/probe specific for a housekeeping gene such as GAPDH which has been labeled with a different fluorophore on the 5' end (typically VIC).

To determine the level of 21617 in various human tissues a primer/probe set was designed. Total RNA was prepared from a series of human tissues using an RNeasy kit from Qiagen. First strand cDNA was prepared from 1 μg total RNA using an oligo-dT primer and Superscript II reverse transcriptase (Gibco/BRL). cDNA obtained from approximately 50 ng total RNA was used per TaqMan® reaction. Tissues tested include the human tissues and several cell lines shown in Tables 11-15. 21617 mRNA was detected in colon cancer cell lines and samples (Tables 11, 12, 15). 21617 mRNA expression was also found in breast, lung, and cervical carcinoma cell lines (Tables 11-15).

TABLE 11

In vitro Expression in Synchronized Cell Cycle Panel

| Tissue Type | Expression |
|---|---|
| HCT 116 Aphidl t = 0 | 63.6 |
| HCT 116 Aphidl t = 3 | 66.3 |
| HCT 116 Aphidl t = 6 | 43.0 |
| HCT 116 Aphidl t = 9 | 70.3 |
| HCT 116 Aphidl t = 12 | 57.1 |
| HCT 116 Aphidl t = 15 | 39.4 |
| HCT 116 Aphidl t = 18 | 57.1 |
| HCT 116 Aphidl t = 21 | 65.2 |
| HCT 116 Aphidl t = 24 | 58.9 |
| HCT 116 Noc t = 0 | 78.8 |
| HCT 116 Noc t = 3 | 92.5 |
| HCT 116 Noc t = 6 | 90.6 |
| HCT 116 Noc t = 9 | 75.1 |
| HCT 116 Noc t = 15 | 86.0 |
| HCT 116 Noc t = 18 | 89.6 |
| HCT 116 Noc t = 21 | 56.9 |
| HCT 116 Noc t = 24 | 66.5 |
| DLD noc t = 0 | 105.5 |
| DLD noc t = 3 | 236.5 |
| DLD noc t = 6 | 216.1 |
| DLD noc t = 9 | 251.7 |
| DLD noc t = 12 | 1117.3 |
| DLD noc t = 15 | 129.4 |
| DLD noc t = 18 | 196.1 |
| DLD noc t = 21 | 170.8 |
| A549 Mimo t = 0 | 110.3 |
| A549 Mimo t = 3 | 160.4 |
| A549 Mimo t = 6 | 64.5 |
| A549 Mimo t = 9 | 54.4 |
| A549 Mimo t = 15 | 48.5 |
| A549 Mimo t = 18 | 62.7 |
| A549 Mimo t = 21 | 53.7 |
| A549 Mimo t = 24 | 69.1 |
| MCF10A Mimo t = 0 | 110.0 |
| MCF10A Mimo t = 3 | 73.6 |
| MCF10A Mimo t = 6 | 49.4 |
| MCF10A Mimo t = 9 | 62.7 |
| MCF10A Mimo t = 12 | 65.8 |

TABLE 11-continued

In vitro Expression in Synchronized Cell Cycle Panel

| Tissue Type | Expression |
|---|---|
| MCF10A Mimo t = 18 | 42.0 |
| MCF10A Mimo t = 21 | 31.8 |
| MCF10A Mimo t = 24 | 25.0 |

Expression of 21617 mRNA in synchronized cells grown in culture is shown in Table 11. Colon cancer cell lines HCT 116 and DLD, human lung carcinoma cell line A549 and human mammary epithelial cell line MCF10A all show expression of 21617 mRNA. The highest level of expression is shown at the mid pint of the cell cycle in DLD cells (colorectal carcinoma cell line).

TABLE 12

21617 Expression In Colon Metastasis Panel

| Tissue Type | Expression |
|---|---|
| CHT 371 Colon N | 0.45 |
| CHT 523 Colon N | 0.10 |
| NDR 104 Colon N | 0.16 |
| CHT 520 Colonic ACA-C | 0.41 |
| CHT 1365 Colonic ACA-C | 0.04 |
| CHT 382 Colonic ACA-B | 2.76 |
| CHT 122 Adenocarcinoma | 0.91 |
| CHT 077 Liver-Colon Mets | 2.76 |
| CHT 739 Liver-Colon Mets | 0.79 |
| CHT 755 Liver-Colon Mets | 6.43 |
| CHT001 Liver-Colon Mets | 2.90 |
| CHT 084 Liver-Colon Mets | 1.50 |
| CHT 113 Liver-Colon Mets | 0.16 |
| CHT 114 Liver-Colon Mets | 35.65 |
| CHT 127 Liver-Colon Mets | 4.07 |
| CHT 137 Liver-Colon Mets | 2.07 |
| CHT 218 Liver-Colon Mets | 0.13 |
| CHT 220 Liver-Colon Mets | 1.98 |
| CHT 324 Liver-Colon Mets | 0.54 |
| CHT 340 Liver-Colon Met | 7.24 |
| CHT 530 Liver-Colon Met | 0.65 |
| CHT 849 Liver-Colon Met | 4.76 |
| CHT 1637 Liver-Colon Met | 1.46 |
| CHT131 Liver-Colon Met | 11.72 |
| NDR 165 Liver Normal | 0.79 |
| NDR 150 Liver Normal | 1.80 |
| PIT 236 Liver Normal | 1.00 |

Expression of 21617 mRNA in a colon tumor metastasis panel is shown in Table 12. One of the colon cancer cell lines displays elevated expression of 21617 mRNA, while a subset of the Liver-Colon metastases express elevated levels of 21617 mRNA, suggesting that 21617 is a marker of cancer of the colon and liver-colon metastases. The highest level of expression in found in a liver metastasis sample.

TABLE 13

21617 Expression in Expanded Breast Panel

| Tissue Type | Expression |
|---|---|
| CHT 2242 Breast Normal | 0.00 |
| CHT 2251 Breast Normal | 2.80 |
| NDR824 Breast Normal | 2.68 |
| CHT 1744 Breast-ILC | 3.77 |
| NDR 133 Breast-ILC | 4.58 |
| CLN 662 Breast-ILC | 0.84 |
| CHT 1985 Breast-ILC | 0.34 |
| CLN 658 Breast-AC IDC II | 1.74 |
| CLN 732 Breast-AC IDC II | 4.52 |

TABLE 13-continued

21617 Expression in Expanded Breast Panel

| Tissue Type | Expression |
|---|---|
| CHT 1828 Breast-Tumor IDC II | 0.15 |
| CHT 2012 Breast-Tumor IDC II | 0.01 |
| CLN 1026 Breast-AC IDC II | 2.77 |
| CLN 1027 Breast-AC IDC II | 1.29 |
| CHT1782 Breast-Tumor IDC III | 6.50 |
| CHT1784 Breast-Tumor IDC III | 27.30 |
| CHT1786 Breast-Tumor IDC III | 0.78 |
| CLN 1023 Breast-AC IDC III | 1.38 |
| CLN 1024 Breast-AC IDC III | 0.50 |
| PIT 058 Lung-Breast Met | 0.00 |
| PIT 116 Lung-Breast Met | 0.33 |
| CHT841 LN-Breast Met | 0.00 |
| CLN 425 LN-Breast Met | 0.04 |
| PIT 059 Liver-Breast Met | 0.87 |
| PIT 236 Liver N | 4.63 |
| PIT 260 Liver N | 0.06 |
| PIT 207 Lung N | 0.87 |
| PIT 298 Lung N | 0.07 |
| Pooled LN normal | 12.01 |
| CHT 2248 Breast Normal | 23.60 |

Table 13 shows 21617 mRNA expression in an Expanded Breast Panel.

TABLE 14

21617 Expression in Oncology Phase II Panel

| Tissue Type | Expression |
|---|---|
| PIT 400 Breast N | 0.00 |
| PIT 372 Breast N | 0.00 |
| CHT 1228 Breast N | 0.00 |
| MDA 304 Breast T: MD-IDC | 0.00 |
| CHT 2002 Breast T: IDC | 0.00 |
| MDA 236-Breast T: PD-IDC (ILC?) | 0.00 |
| CHT 562 Breast T: IDC | 3.44 |
| NDR 138 Breast T ILC (LG) | 6.90 |
| CHT 1841 Lymph node (Breast met) | 0.00 |
| PIT 58 Lung (Breast met) | 0.00 |
| CHT 620 Ovary N | 0.00 |
| CHT 619 Ovary N | 0.00 |
| CLN 012 Ovary T | 0.00 |
| CLN 07 Ovary T | 0.00 |
| CLN 17 Ovary T | 0.00 |
| MDA 25 Ovary T | 0.00 |
| CLN 08 Ovary T | 0.00 |
| PIT 298 Lung N | 0.00 |
| MDA 185 Lung N | 0.00 |
| CLN 930 Lung N | 0.00 |
| MPI 215 Lung T--SmC | 0.43 |
| MDA 259 Lung T-PDNSCCL | 30.93 |
| CHT 832 Lung T-PDNSCCL | 1.26 |
| MDA 262 Lung T-SCC | 5.96 |
| CHT 793 Lung T-ACA | 0.20 |
| CHT 331 Lung T-ACA | 0.00 |
| CHT 405 Colon N | 0.00 |
| CHT 1685 Colon N | 0.00 |
| CHT 371 Colon N | 0.01 |
| CHT 382 Colon T: MD | 0.23 |
| CHT 528 Colon T: MD | 0.12 |
| CLN 609 Colon T | 0.18 |
| NDR 210 Colon T: MD-PD | 0.82 |
| CHT 340 Colon-Liver Met | 4.14 |
| CHT 1637 Colon-Liver Met | 0.61 |
| PIT 260 Liver N (female) | 0.10 |
| CHT 1653 Cervix Squamous CC | 13.94 |
| CHT 569 Cervix Squamous CC | 0.00 |
| A24 HMVEC-Arr | 0.96 |
| C48 HMVEC-Prol | 0.10 |
| Pooled Hemangiomas | 0.00 |
| HCT116N22 Normoxic | 7.84 |
| HCT116H22 Hypoxic | 2.02 |

Table 14 shows 21617 mRNA expression in an oncology phase II panel. The highest level of expression was found in lung tumor and cervical squamous carcinoma. In addition, elevated expression of 21617 mRNA was detected in a subset of breast (IDC and ILC) and lung tumor (PDNSCCL and SCC) samples as compared to normal breast and lung tissue. Expression of 21617 mRNA was also detected in human vascular endothelial cells (HMVECs).

TABLE 15

21617 Expression in Xenograft Panel

| Tissue Type | Expression |
|---|---|
| MCF-7 Breast T | 16.63 |
| ZR75 Breast T | 33.84 |
| T47D Breast T | 24.43 |
| MDA 231 Breast T | 0.24 |
| MDA 435 Breast T | 1.58 |
| SKBr3 Breast | 75.10 |
| DLD 1 ColonT (stage C) | 138.22 |
| SW480 Colon T (stage B) | 6.99 |
| SW620 ColonT (stage C) | 92.46 |
| HCT116 | 19.37 |
| HT29 | 4.38 |
| Colo 205 | 32.69 |
| NCIH125 | 9.55 |
| NCIH67 | 83.33 |
| NCIH322 | 50.42 |
| NCIH460 | 1.95 |
| A549 | 11.92 |
| NHBE | 35.40 |
| SKOV-3 ovary | 6.87 |
| OVCAR-3 ovary | 8.37 |
| 293 Baby Kidney | 27.97 |
| 293T Baby Kidney | 113.05 |

Table 15 shows 21617 mRNA expression in a xenograft panel. Stage C colon tumor DLD cells showed the highest relative level of expression.

Human 55562

The human 55562 sequence (see SEQ ID NO:82 and section below entitled "Identification and Characterization of Human 55562 cDNA"), which is approximately 1327 nucleotides long including untranslated regions, contains a predicted methionine-initiated coding sequence of about 825 nucleotides, including the termination codon. The coding sequence encodes a 274 amino acid protein (see SEQ ID NO:83 and section below entitled "Identification and Characterization of Human 55562 cDNA").

Human 55562 contains the following regions or other structural features: a tetratricopeptide repeat domain (PFAM Accession Number PF00515) located at about amino acid residues 40 to 73 of SEQ ID NO:83; a PD314595 homology domain (ProDom Accession Number PD314595) located at about amino acid residues 40 to 266 of SEQ ID NO:83; four predicted Protein Kinase C phosphorylation sites (PS00005) located at about amino acid residues 3 to 5, 22 to 24, 81 to 83, and 201 to 203 of SEQ ID NO:83; four predicted Casein Kinase II phosphorylation sites (PS00006) located at about amino acid residues 139 to 142, 180 to 183, 216 to 219, 261 to 264 of SEQ ID NO:83; three predicted cAMP/cGMP-dependent protein kinase phosphorylation sites (PS00004) located at about amino acid residues 5 to 8, 19 to 22, and 268 to 271 of SEQ ID NO:83; two predicted N-glycosylation sites (PS00001) located at about amino acid residues 122 to 125, 137 to 140 of SEQ ID NO:83; and one predicted N-myristylation sites (PS00008) located at about amino acid residues 76 to 81 of SEQ ID NO:83.

For general information regarding PFAM identifiers, PS prefix and PF prefix domain identification numbers, refer to Sonnhammer et al. (1997) *Protein* 28:405-420.

The 55562 protein contains a significant number of structural characteristics in common with members of the tetratricopeptide repeat (TPR) family. The term "family" when referring to the protein and nucleic acid molecules of the invention means two or more proteins or nucleic acid molecules having a common structural domain or motif and having sufficient amino acid or nucleotide sequence homology as defined herein. Such family members can be naturally or non-naturally occurring and can be from either the same or different species. For example, a family can contain a first protein of human origin as well as other distinct proteins of human origin, or alternatively, can contain homologues of non-human origin, e.g., rat or mouse proteins. Members of a family can also have common functional characteristics.

A common fold characterizes the TPR domains of the TPR family of proteins. TPR repeats can be highly degenerate. However, a pattern of small and large residues is required for the repeat to adopt the TPR fold. Each repeat of a TPR domain folds into an antiparallel pair of α-helices. Adjacent repeats can pack against one another in a parallel format to produce a right-handed super-helical structure with a continuous amphipathic groove, e.g., a possible binding site of an α-helix of an interaction partner (Das et al., supra).

Tetratricopeptide repeats (TPR) are found in a diverse collection of polypeptides (Boebel and Yanagida (1991) Trends Biochem Sci. 16:173; Lamb et al. (1995) Trends Biochem. Sci. 20:257). Typically, each repeat folds as an anti-parallel pair of 1-helices; adjacent repeats pack against each other to form an extensive accordion-like structure. This polypeptide fold can serve a variety of functions, including scaffolding protein-protein interactions for complex formation and regulation of protein function.

For example, the serine/threonine protein phosphatase PP5 has three tandem TPR motifs that have multiple functions (see, e.g., Das et al. (1998), *EMBO J.* 17:1192-99). In part, the TPR domain of PP5 is an allosteric regulator that inhibits phosphatase function until triggered by arachidonic acid. Arachidonic acid binds to the TPR domain, and relieves the inhibition, thereby activating the enzyme. Additionally, the TPR domain interacts with hsp90 and the kinase domain of the ANP-guanylate cyclase receptor in a signalling network.

TPR motifs are also found in cell division cycle genes, such as cdc16, cdc23, and cdc27, all encoding polypeptide components of the anaphase-promoting complex, which regulates cell cycle progression in mitosis. Mutations in the TPR regions of these complex members cause mitotic arrest prior to anaphase.

Another class of proteins, the SKD1 family of proteins contains a sole TPR motif. SKD1 family members, including VPS4, participate in intracellular protein trafficking, e.g., from the trans-Golgi network to the vacuole. This family of proteins can further include an AAA domain (an ATPase motif).

TPRs are also featured in proteins that regulate transcription, neurogenesis, protein kinase inhibition, NADPH oxidase, and protein folding. Thus, the TPR is a versatile and important polypeptide motif for regulating cell behaviors and physiology.

TPR domains can serve a variety of functions, including scaffolding protein-protein interactions for complex formation and regulation of protein function. Consequently, TPRs have been found in proteins that regulate a variety of different processes, including transcription, neurogenesis, signal transduction, metabolism, and protein folding and trafficking.

A 55562 polypeptide can include a "TPR domain" or regions homologous with a "TPR domain".

As used herein, the terms "tetratricopeptide repeat domain" or "TPR domain" include an amino acid sequence of about 20 to 45 amino acid residues in length and having a bit score for the alignment of the sequence to the TPR domain (HMM) of at least 5. Preferably, a TPR domain includes at least about 15 to 60 amino acids, more preferably about 20 to 45 amino acid residues, or about 27 to 36 amino acids and has a bit score for the alignment of the sequence to the TPR domain (HMM) of at least 1, 2, 3, 4, 5, 6, 7, or greater. Preferably, a TRP domain includes at least one small hydrophobic residue in both the first and second helix which are capable of interacting with one another such that interaction between the two helices is stabilized. In addition, a TRP domain can include a conserved aromatic residue. The TPR domain (HMM) has been assigned the PFAM Accession Number PF00515. An alignment of the TPR domain (amino acids 40 to 73 of SEQ ID NO:83) of human 55562 with a TPR consensus amino acid sequence (SEQ ID NO:86) derived from a hidden Markov model, demonstrates that human 55562 includes alanine residues located at about amino acid residues 47 and 58 of SEQ ID NO:83, as well as a tyrosine residue located at about amino acid residue 55 of SEQ ID NO:83.

In a preferred embodiment, a 55562 polypeptide or protein has a "TPR domain" or a region which includes at least about 15 to 60 more preferably about 20 to 45 or 27 to 36, e.g., about 33 amino acid residues and has at least about 60%, 70%, 80%, 90%, 95%, 98%, 99%, or 100% homology with a "TPR domain," e.g., the TPR domain of human 55562 (e.g., residues 40 to 73 of SEQ ID NO:83).

To identify the presence of a "TPR" domain in a 55562 protein sequence, and make the determination that a polypeptide or protein of interest has a particular profile, the amino acid sequence of the protein can be searched against the PFAM database of HMMs (e.g., the Pfam database, release 2.1) using the default parameters. For example, the hmmsf program, which is available as part of the HMMER package of search programs, is a family specific default program for MILPAT0063 and a score of 15 is the default threshold score for determining a hit. Alternatively, the threshold score for determining a hit can be lowered (e.g., to 8 bits). A description of the PFAM database can be found in Sonhammer et al. (1997) *Proteins* 28(3):405-420 and a detailed description of HMMs can be found, for example, in Gribskov et al. (1990) *Meth. Enzymol.* 183:146-159; Gribskov et al. (1987) *Proc. Natl. Acad. Sci. USA* 84:4355-4358; Krogh et al. (1994) *J. Mol. Biol.* 235:1501-1531; and Stultz et al. (1993) *Protein Sci.* 2:305-314, the contents of which are incorporated herein by reference. A search was performed against the HMM database resulting in the identification of a "TPR domain" domain in the amino acid sequence of human 55562 located at about amino acid residues 40 to 73 of SEQ ID NO:83 (the identified Pfam "TPR domain" domain consensus amino acid sequence of human 55562 corresponds to SEQ ID NO:86).

A 55562 family member can further include a "PD314595 homology domain" or regions homologous with a "PD314595 homology domain".

As used herein, the term "PD314595 homology domain" includes an amino acid sequence of about 150 to 300 amino acid residues in length and having a bit score for the alignment of the sequence to the TPR domain (HMM) of at least 70. Preferably, a PD314595 homology domain includes at least about 175 to 275 amino acids, more preferably about 200 to 250 amino acid residues, or about 220 to 235 amino acids and has a bit score for the alignment of the sequence to the TPR domain (HMM) of at least 100, 125, 130, 135, 140, or greater. Preferably, a PD314595 homology domain includes at least one tetratricopeptide repeat located near the N-terminus of the domain. The PD314595 homology domain has been given the ProDom accession number PD134595. An alignment of the PD314595 homology domain (about amino acids 40 to 266 of SEQ ID NO:83) of human 55562 with a PD314595 homology domain consensus amino acid sequence (SEQ ID NO:87) demonstrates a 35% identity between the two sequences.

In a preferred embodiment, a 55562 polypeptide or protein has a "PD314595 homology domain" or a region which includes at least about 175 to 275, more preferably about 200 to 250, or about 220 to 235 amino acid residues and has at least about 60%, 70%, 80%, 90%, 95%, 98%, 99%, or 100% homology with a "PD314595 homology domain," e.g., the PD314595 homology domain of human 55562 (e.g., residues 40 to 266 of SEQ ID NO:83).

To identify the presence of a "PD314595 homology domain" in a 55562 protein sequence, and make the determination that a polypeptide or protein of interest has a particular profile, the human 55562 amino acid sequence can be searched against the ProDom database of domains (Corpet et al. (1999), *Nucl. Acids Res.* 27:263-267). The ProDom protein domain database consists of an automatic compilation of homologous domains. Current versions of ProDom are built using recursive PSI-BLAST searches (Altschul S F et al. (1997) *Nucleic Acids Res.* 25:3389-3402; Gouzy et al. (1999) *Computers and Chemistry* 23:333-340.) of the SWISS-PROT 38 and TREMBL protein databases. The database automatically generates a consensus sequence for each domain. A BLAST search was performed against the ProDom database resulting in the identification of a consensus amino acid sequence for the PD314595 homology domain in the amino acid sequence of human 55562 at about residues 40 to 266 of SEQ ID NO:83 (the identified ProDom "PD314595 homology" domain consensus amino acid sequence of human 55562 corresponds to SEQ ID NO:87).

A 55562 family member can further include a "PD014461 p99.2 domain" or regions homologous with a "PD014461 p99.2 domain".

As used herein, the term "PD014461 p99.2 domain" includes an amino acid sequence of about 30 to 90 amino acid residues in length and having a bit score for the alignment of the sequence to the TPR domain (HMM) of at least 50. Preferably, a PD314595 homology domain includes at least about 40 to 80 amino acids, more preferably about 50 to 70 amino acid residues, or about 55 to 65 amino acids and has a bit score for the alignment of the sequence to the TPR domain (HMM) of at least 60, 75, 80, or greater. The PD014461 p99.2 domain has been given the ProDom accession number PD014461. An alignment of the PD014461 p99.2 domain (about amino acids 40 to 97 of SEQ ID NO:83) of human 55562 with a PD014461 p99.2 domain consensus amino acid sequence (SEQ ID NO:88) demonstrates a 30% identity between the two sequences.

To identify the presence of a "PD014461 p99.2 domain" in a 55562 protein sequence, and make the determination that a polypeptide or protein of interest has a particular profile, the human 55562 amino acid sequence can be searched against the ProDom database of domains (Corpet et al. (1999), *Nucl. Acids Res.* 27:263-267). The ProDom protein domain database consists of an automatic compilation of homologous domains. Current versions of ProDom are built using recursive PSI-BLAST searches (Altschul S F et al. (1997) *Nucleic Acids Res.* 25:3389-3402; Gouzy et al. (1999) *Computers and Chemistry* 23:333-340.) of the SWISS-PROT 38 and TREMBL protein databases. The database automatically generates a consensus sequence for each domain. A BLAST search was performed against the ProDom database resulting in the identification of a consensus amino acid sequence for the PD014461 p99.2 domain in the amino acid sequence of human 55562 at about residues 40 to 97 of SEQ ID NO:83 (the identified ProDom "PD014461 p99.2" domain consensus amino acid sequence of human 55562 corresponds to SEQ ID NO:88).

A 55562 family member can include at least one TPR domain, at least one PD314595 homology domain and at least one PD014461 p99.2 domain. Furthermore, a 55562 family member can include at least one, preferably two predicted N-glycosylation sites; at least one, two, three, preferably four protein kinase C phosphorylation sites (PS00005); at least one, two, three, preferably four predicted casein kinase II phosphorylation sites (PS00006); at least one, two, preferably three cAMP and cGMP-dependent protein kinase phosphorylation sites; and at least one predicted N-myristylation sites (PS00008).

55562 polypeptides of the invention include fragments which include: all or part of a hydrophobic sequence, e.g., the sequence from about amino acid 39 to 44, from about 66 to 76, and from about 156 to 167 of SEQ ID NO:83; and all or part of a hydrophilic sequence, e.g., the sequence of from about amino acid 2 to 9, from about 95 to 110, and from about 259 to 273 of SEQ ID NO:83.

As the 55562 polypeptides of the invention may modulate 55562-mediated activities, they may be useful as of for developing novel diagnostic and therapeutic agents for 55562-mediated or related disorders, as described below.

As used herein, a "55562 activity", "biological activity of 55562" or "functional activity of 55562", refers to an activity exerted by a 55562 protein, polypeptide or nucleic acid molecule on e.g., a 55562-responsive cell or on a 55562 substrate, e.g., a protein substrate, as determined in vivo or in vitro. In one embodiment, a 55562 activity is a direct activity, such as an association with a 55562 target molecule. A "target molecule" or "binding partner" is a molecule with which a 55562 protein binds or interacts in nature. In an exemplary embodiment, 55562 is a receptor, e.g., for a polyunsaturated fatty acid; a interface for binding a chaperone; or an interface for scaffolding with a protein complex. A 55562 activity can also be an indirect activity, e.g., a cellular signaling activity mediated by interaction of the 55562 protein with a 55562 receptor.

Based on the above-described sequence similarities, the 55562 molecules of the present invention are predicted to have similar biological activities as TPR family members. For example, the 55562 proteins of the present invention can have one or more of the following activities: (1) sensing a second messenger, e.g., a polyunsaturated fatty acid (e.g., arachidonic acid); (2) associating with other proteins so as to form a multimeric protein assembly; (3) allosterically inhibiting an enzyme activity, e.g., an anaphase promoting activity, a kinase activity, or a phosphatase activity; (4) regulating an intracellular trafficking pathway; (5) interfacing with intracellular trafficking landmark and regulator proteins; (6) regulation of metabolic processes including, e.g., regulation of metabolic enzymes, e.g., NADPH oxidase; or (7) inhibiting any of (1)-(6), e.g., via the formation of a dominant negative fragment of 55562.

Thus, the 55562 molecules can act as novel diagnostic targets and therapeutic agents for controlling cell proliferation and/or differentiation disorders, neural disorders (e.g., disorders of the brain), metabolic disorders, or viral disorders (e.g., as related to the viral inhibition of protein trafficking).

Identification and Characterization of Human 55562 cDNA

The human 55562 nucleic acid sequence is recited as follows:

(SEQ ID NO: 82)
CCTGCTGCAATGGCTTACGGGAGCCAATGTGACGGGATCAGGGCAGACCC

ATTTAGGGTTTCGTAACCGGCCAATTCAGTACGCAATAGGGAAAATCAAT

TAGGATCTGCAGAGGGTTCCCGGATACACCTTGCGAAGAATGCCGCACTC

TCCGCCACTCATTCCCCACTCACCGGCACCCGCTAAACCTTCAGCCTGAA

ATTTTCCTCCGAAGGAAGCAGAGCAGAGGAAGAACTACCAAGTGCTACAC

TCAAAGCCTGCCGTCGCAGTGAGCGCGACCTCCAAACTGAGGCATTTTTG

TTCCGGCGAAATCCCTCCCACTCAGGAAAGTCCCTAGAAAGAGAGCGCAG

GCGCCTGGGGTATCACATGACCACTTCCCGGAAGCGCAGCAGACCCGCTC

AACTTCATCCTGGGTTGAGGCGGAGGAGAACTTCCAGAATTATGGCGAAG

TCCGGGCTGAGGCAGGACCCGCAGAGCACAGCTGCAGCCACTGTGCTAAA

GCGGGCAGTAGAACTAGATTCGGAGTCGCGGTATCCGCAGGCTCTGGTGT

GTTACCAAGAGGGGATTGATCTGCTCCTGCAGGTTCTGAAAGGTACCAAA

GATAATACTAAGAGATGTAATCTCAGAGAAAAATTTCCAAATACATGGA

CAGAGCGGAAAACATAAAGAAGTACTTGGACCAAGAAAAAGAAGATGGAA

AATATCACAAGCAAATTAAAATAGAAGAGAATGCAACAGGTTTCAGTTAT

GAGTCACTTTTTCGCGAATACCTTAATGAGACAGTTACAGAAGTTTGGAT

AGAAGATCCTTATATTAGACATACTCATCAGCTGTATAACTTTCTTCGAT

TTTGTGAGATGCTTATTAAGAGACCATGTAAAGTAAAAACTATTCACCTT

CTCACCTCTCTGGATGAAGGCATTGAGCAAGTGCAGCAAAGTAGAGGCCT

GCAAGAAATAGAAGAGTCACTCAGGAGTCACGGAGTGCTGTTGGAAGTTC

AATACTCTTCTTCAATACATGACCGAGAAATTAGGTTCAACAATGGATGG

ATGATTAAGATTGGAAGGGGACTTGATTATTTTAAGAAACCACAGAGTCG

TTTTTCCCTTGGATATTGTGATTTTGATTTAAGACCATGTCATGAAACAA

CAGTAGACATTTTTCATAAGAAGCATACAAAAAATATATGATGGGTGGTA

GCCTAATTTGTATTATGTCTACTTTAAGTGAATATTGGATTTTTTTTAAA

AGATCACTTTTATAATGTATGAATTTAACAATAAACTTTTATATTTCTAC

TAAAAAAAAAAAAAAAAAAAAAAAA.

The human 55562 sequence (SEQ ID NO:82) is approximately 1327 nucleotides long. The nucleic acid sequence includes an initiation codon (ATG) and a termination codon (TGA), which are indicated in bold and underscored above. The region between and inclusive of the initiation codon and the termination codon is a methionine-initiated coding sequence of about 825 nucleotides, including the termination codon (nucleotides 367 to 1191 of SEQ ID NO:82; SEQ ID NO:84). The coding sequence encodes a 274 amino acid protein (SEQ ID NO:83), which is recited as follows:

(SEQ ID NO: 83)
MTTSRKRSRPAQLHPGLRRRRTSRIMAKSGLRQDPQSTAAATVLKRAVEL

DSESRYPQALVCYQEGIDLLLQVLKGTKDNTKRCNLREKISKYMDRAENI

KKYLDQEKEDGKYHKQIKIEENATGFSYESLFREYLNETVTEVWIEDPYI

RHTHQLYNFLRFCEMLIKRPCKVKTIHLLTSLDEGIEQVQQSRGLQEIEE

SLRSHGVLLEVQYSSSIHDREIRFNNGWMIKIGRGLDYFKKPQSRFSLGY

CDFDLRPCHETTVDIFHKKHTKNI.

Human 39228

The present invention is based, at least in part, on the discovery of novel molecules, referred to herein interchangeably as "39228", "Alcohol Dehydrogenase-Related Protein-1," "Adh-Related Protein-1," or "Adhr-1" nucleic acid and protein molecules, which are novel members of a family of enzymes possessing alcohol dehydrogenase (Adh) activity. These novel molecules are capable of oxidizing alcohol groups, or reducing aldehyde groups, by catalyzing the transfer of a hydride moiety and, thus, play a role in or function in a variety of cellular processes, e.g., energy-related metabolism, proliferation, differentiation, visual systems, hormonal responses, and inter- or intra-cellular communication.

The oxidation and reduction of molecules which contain alcohol and aldehyde groups is of critical importance in many metabolic and catabolic pathways in cells. A large family of enzymes which facilitate many of these molecular alterations, termed alcohol dehydrogenases (Adh), has been identified. In the forward reaction, these enzymes catalyze the transfer of a hydride ion from the target alcohol group to the enzyme or a cofactor of the enzyme (e.g., $NAD^+$), thereby forming an aldehyde group on the substrate. These enzymes are also able to participate in the reverse reaction, wherein a carbonyl group on the target aldehyde is reduced to an alcohol by the transfer of a hydride group from the enzyme.

Members of the alcohol dehydrogenase family are found in nearly all organisms, from microbes to *Drosophila* to humans. Both between species and within the same species, alcohol dehydrogenase isozymes vary widely. For example, members of the human Adh family are encoded by at least seven genes. These isozymes can be divided into at least 4 classes which are all found in the liver and can be distributed differentially throughout other human tissues according to function. Class I Adh isozymes appear to have the widest range of substrates by virtue of their integral involvement with hepatic processing of ethanol, bile compounds, testosterone, neurotransmitters, retinol, peroxidic aldehydes, congeners, and mevalonate. Class II Adh isozymes are involved with many of the same processing pathways as Class I, but appear to play at most a minor role in ethanol processing. Class III Adh isozymes are not able to oxidize ethanol, but function in formaldehyde and fatty acid metabolism. Class IV Adh isozymes are particularly important for retinol to vitamin A metabolism and "first pass" processing of dietary alcohol. As such, their activity is highest in the stomach and cornea (Holmes (1994) *Alcohol Alcohol Suppl* 2:127-130;).

The importance of Adh isozymes in such a wide array of metabolic pathways implicates them in many important biological processes, including embryological development (Duester, *Experimental Biology Symposium*—Apr. 9, 1997: *Functional Metabolism of Vitamin A in Embryonic Development*, Editor: M. H. Zile, pp 459S-462S); the ability of the cell to grow and differentiate, to generate and store energy, and to communicate and interact with other cells. Alcohol dehydrogenases also are important in the detoxification of compounds to which an organism is exposed, such as alcohols, toxins, carcinogens, and mutagens. Links between the variability of Adh activity and predisposition to alcoholism have been proposed (Whitfield (1994) *Alcohol Alcohol Suppl* 2:59-65; Jornvall (1994) *EXS* 71:221-229).

As used herein, the terms "alcohol dehydrogenase" and "Adh" include a molecule which is involved in the oxidation or reduction of a biochemical molecule (e.g., metabolic precursor which contains an alcohol group or an aldehyde group) by catalyzing the transfer of a hydride ion to or from the biochemical molecule. Alcohol dehydrogenase molecules are involved in the metabolism and catabolism of biochemical molecules necessary for energy production or storage, for intra- or intercellular signaling, for metabolism or catabolism of metabolically important biomolecules, and for detoxification of potentially harmful compounds (e.g., ethanol). Thus, the Adhr-1 molecules of the present invention provide novel diagnostic targets and therapeutic agents to control Adh-associated disorders and/or lipid metabolism-associated disorders.

As used herein, the term "Adh-associated disorder" includes a disorder, disease or condition which is caused or characterized by a misregulation (e.g., downregulation or upregulation) of Adh activity. Adh-associated disorders can detrimentally affect cellular functions such as cellular proliferation, growth, differentiation, inter- and intra-cellular communication, energy production and energy storage; tissue function, such as cardiac function, CNS function, or musculoskeletal function; systemic responses in an organism, such as nervous system responses or digestive responses; and protection of cells from toxic compounds (e.g., alcohols, carcinogens, toxins, or mutagens). Examples of Adh-associated disorders include metabolic disorders (e.g., hyper- or hypolipoproteinemias, diabetes mellitus, and familial hypercholesterolemia); disorders related to toxins and/or alcohol consumption (e.g., alcoholism, cirrhosis, or depression); disorders related to the CNS (e.g., cognitive and neurodegenerative disorders stemming from aberrant metabolism of neurotransmitters or degradation resulting from alcohol damage); disorders related to retinol metabolism (e.g., embryological disorders, visual disorders or night blindness).

The present invention also provides methods and compositions for the diagnosis and treatment of tumorigenic disease, e.g., lung tumors, ovarian tumors, colon tumors, prostate tumors, breast tumors, and cervical squamous cell carcinoma. The present invention is based, at least in part, on the discovery that "Adhr-1 is differentially expressed in tumor tissue samples relative to its expression in normal tissue samples.

"Differential expression", as used herein, includes both quantitative as well as qualitative differences in the temporal and/or tissue expression pattern of a gene. Thus, a differentially expressed gene may have its expression activated or inactivated in normal versus tumorigenic disease conditions (for example, in an experimental tumorigenic disease system). The degree to which expression differs in normal versus tumorigenic disease or control versus experimental states need only be large enough to be visualized via standard characterization techniques, e.g., quantitative PCR, Northern analysis, or subtractive hybridization. The expression pattern of a differentially expressed gene may be used as part of a prognostic or diagnostic tumorigenic disease evaluation, or may be used in methods for identifying compounds useful for the treatment of tumorigenic disease. In addition, a differentially expressed gene involved in a tumorigenic disease may represent a target gene such that modulation of the level of target gene expression or of target gene product activity may act to ameliorate a tumorigenic disease condition. Compounds that modulate target gene expression or activity of the target gene product can be used in the treatment of tumorigenic disease. Although the Adhr-1 genes described herein may be differentially expressed with respect to tumorigenic disease, and/or their products may interact with gene products important to tumorigenic disease, the genes may also be involved in mechanisms important to additional cell processes, e.g., muscle cell processes.

The Adhr-1 molecules of the present invention further provide novel diagnostic targets and therapeutic agents for treating musculo-skeletal disorders as this gene is highly expressed in skeletal muscle tissue. Alcohol Dehydrogenase has been shown to serve as a substrate for the chaperon like molecule alpha B-crystallin, a member of the small heat shock protein family. AlphaB-crystallin is a major lens protein and is also expressed in skeletal and cardiac muscle (Bova M. P., et al. (1999) *Proc Natl Acad Sci USA* 96: 6137). One of the many functions of molecular chaperons is to prevent mis-associations and to promote proper folding of proteins. Thus, the Adhr-1 molecules of the present invention may provide a means of treating diseases such as cataract; desmin related myopathy and other potential diseases that arise from misfolding of the Adhr-1 protein.

Moreover, it has been demonstrated that when mice are subjected to ultraviolet radiation (UVR) exposure and monitored for ocular aldehyde dehydrogenase (ALDH) and alcohol dehydrogenase (ADH) activity, dramatic reductions in ALDH and ADH activities were observed by 4-6 days post-exposure, resulting in enzyme levels of 15-16% of control animals. Major decreases in corneal enzyme levels were predominantly responsible for these changes (Downes J. E., et al., (1993) *Cornea* 12: 241). Expression of Adhr-1 in the retina suggests that the Adhr-1 molecules of the present invention may be used in assisting the cornea to protect the eye against UVR-induced tissue damage.

The term "family" when referring to the protein and nucleic acid molecules of the invention is intended to mean two or more proteins or nucleic acid molecules having a common structural domain or motif and having sufficient amino acid or nucleotide sequence homology as defined herein. Such family members can be naturally or non-naturally occurring and can be from either the same or different species. For example, a family can contain a first protein of human origin, as well as other, distinct proteins of human origin or alternatively, can contain homologues of non-human origin. Members of a family may also have common functional characteristics.

For example, the family of Adhr-1 proteins comprise at least one, and preferably two or more "transmembrane domains." As used herein, the term "transmembrane domain" includes an amino acid sequence of about 15 amino acid residues in length which spans the plasma membrane. More preferably, a transmembrane domain includes about at least 10, 15, 20, 25, 30, 35, 40, 45 or more amino acid residues and spans the plasma membrane. Transmembrane domains are rich in hydrophobic residues, and typically have a helical structure. In one embodiment, at least 50%, 60%, 70%, 80%, 90%, 95% or more of the amino acid residues of a transmembrane domain are hydrophobic, e.g., leucines, isoleucines, tyrosines, or tryptophans. Transmembrane domains are described in, for example, Zagotta W. N. et al., (1996) *Annual Rev. Neurosci.* 19:235-63, the contents of which are incorporated herein by reference. Amino acid residues 148-164 and 266-282 of the human Adhr-1 polypeptide (SEQ ID NO:90) comprise transmembrane domains.

In another embodiment, an Adhr-1 molecule of the present invention is identified based on the presence of an "ADH-Zn domain" (also referred to above as "Zinc-containing alcohol dehydrogenase signature domain") in the protein or corresponding nucleic acid molecule. As used herein, the term "ADH-Zn domain" includes a protein domain having an amino acid sequence of about 322 amino acid residues and having a bit score for the alignment of the sequence to the ADH-Zn domain (HMM) of about 1, 5, 10, 20, 30, 40, 50 or greater. Preferably, an ADH-Zn domain includes at least about 275-375, more preferably about 300-350 amino acid residues, or most preferably about 315-335 amino acids and has a bit score for the alignment of the sequence to the ADH-Zn domain (HMM) of at least about 1, 5, 10, 20, 30, 40, 50 or greater. The ADH-Zn domain has been assigned the PFAM label "ADH_ZINC" under Accession number PS00059. ADH-Zn domains are involved in Adh activity and are described in, for example, Joernvall et al (1987) *Eur. J. Biochem.* 167:195-201; Joernvall et al (1993) *FEBS Letters* 322: 240-244, the contents of which are incorporated herein by reference.

In another embodiment, an Adhr-1 molecule of the present invention is identified based on the presence of a "Lipase-SER domain" (also referred to above as "serine-containing active domain of the 'G-D-S-L' family of lipases") in the protein or corresponding nucleic acid molecule. As used herein, the term "Lipase-SER domain" includes a protein domain having an amino acid sequence of about 86 amino acid residues and having a bit score for the alignment of the sequence to the Lipase-SER domain (HMM) of about 1, 5, 10, 20, 30, 40, 50 or greater. Preferably, a Lipase-SER domain includes at least about 40-125, more preferably about 60-105 amino acid residues, or most preferably about 75-95 amino acids and has a bit score for the alignment of the sequence to the ADH-Zn domain (HMM) of at least about 1, 5, 10, 20, 30, 40, 50 or greater. The Lipase-SER domain has been assigned the PFAM label "LIPASE_GDSL_SER" under Accession number PS01098. Lipase-SER domains are involved in lipase and/or phospholipase activity and are described in, for example, Upton and Buckley (1995) *TIBS* 20:178-179, the contents of which are incorporated herein by reference.

To identify the presence of an ADH-Zn and/or a Lipase-SER domain in an Adhr-1 protein and make the determination that a protein of interest has a particular profile, the amino acid sequence of the protein is searched against a database of HMMs (e.g., the Pfam database, release 2.1) using the default parameters. A description of the Pfam database can be found in Sonhammer et al. (1997) *Proteins* 28(3)405-420 and a detailed description of HMMs can be found, for example, in Gribskov et al. (1990) *Meth. Enzymol.* 183:146-159; Gribskov et al. (1987) *Proc. Natl. Acad. Sci. USA* 84:4355-4358; Krogh et al. (1994) *J. Mol. Biol.* 235:1501-1531; and Stultz et al. (1993) *Protein Sci.* 2:305-314, the contents of which are incorporated herein by reference. A search was performed against the HMM database resulting in the identification of an ADH-Zn domain and a Lipase-SER domain in the amino acid sequence of SEQ ID NO:90 (at about residues 47-368 and 103-189 of SEQ ID NO:90, respectively).

Isolated Adhr-1 proteins of the present invention, have an amino acid sequence sufficiently identical to the amino acid sequence of SEQ ID NO:90, or are encoded by a nucleotide sequence sufficiently identical to SEQ ID NO:89 or 91. As used herein, the term "sufficiently identical" refers to a first amino acid or nucleotide sequence which contains a sufficient or minimum number of identical or equivalent (e.g., an amino acid residue which has a similar side chain) amino acid residues or nucleotides to a second amino acid or nucleotide sequence such that the first and second amino acid or nucleotide sequences share common structural domains or motifs and/or a common functional activity. For example, amino acid or nucleotide sequences which share common structural domains have at least 30%, 40%, or 50% homology, preferably 60% homology, more preferably 70%-80%, and even more preferably 90-95% homology across the amino acid sequences of the domains and contain at least one and preferably two structural domains or motifs, are defined herein as sufficiently identical. Furthermore, amino acid or nucleotide sequences which share at least 30%, 40%, or 50%, preferably 60%, more preferably 70-80%, or 90-95% homology and share a common functional activity are defined herein as sufficiently identical.

As used interchangeably herein, a "Adhr-1 activity", "biological activity of Adhr-1," or "functional activity of Adhr-1," includes an activity exerted by an Adhr-1 protein, polypeptide or nucleic acid molecule on an Adhr-1-responsive cell or tissue, or on an Adhr-1 protein substrate, as determined in vivo, or in vitro, according to standard techniques. In one embodiment, an Adhr-1 activity is a direct activity, such as an association with an Adhr-1-target molecule. As used herein, a "target molecule" or "binding partner" is a molecule with which an Adhr-1 protein binds or interacts in nature, such that Adhr-1-mediated function is achieved. An Adhr-1 target molecule can be a non-Adhr-1 molecule or an Adhr-1 accessory polypeptide or molecule of the present invention (e.g., $NAD^+$, a $Zn^+$ molecule, or other cofactor). As used herein, an "accessory" peptide or molecule refers to a peptide or molecule whose presence is may be needed for the proper activity of a protein (e.g., a cofactor or a metal ion that is needed by an enzyme). In an exemplary embodiment, an Adhr-1 target molecule is an Adhr-1 ligand (e.g., an alcohol, an aldehyde, a retinol or a lipid). Alternatively, an Adhr-1 activity is an indirect activity, such as a cellular signaling activity mediated by interaction of the Adhr-1 protein with an Adhr-1 ligand. The biological activities of Adhr-1 are described herein. For example, the Adhr-1 proteins of the present invention can have one or more of the following activities: 1) modulate metabolism and catabolism of biochemical molecules necessary for energy production or storage, 2) modulate or facilitate intra- or intercellular signaling, 3) modulate metabolism or catabolism of metabolically important biomolecules, and 4) modulate detoxification of potentially harmful compounds.

Accordingly, another embodiment of the invention features isolated Adhr-1 proteins and polypeptides having an Adhr-1 activity. Other preferred proteins are Adhr-1 proteins having one or more of the following domains: a transmembrane domain, an ADH-Zn domain, a Lipase-SER domain, and, preferably, an Adhr-1 activity. Additional preferred Adhr-1 proteins have at least one ADH-Zn, and/or at least one Lipase-SER, and/or at least one transmembrane domain and are, preferably, encoded by a nucleic acid molecule having a nucleotide sequence which hybridizes under stringent hybridization conditions to a nucleic acid molecule comprising the nucleotide sequence of SEQ ID NO:89 or 91.

The nucleotide sequence of the isolated human Adhr-1 cDNA and the predicted amino acid sequence of the human Adhr-1 polypeptide are shown in SEQ ID NO:89 and SEQ ID NO:90, respectively.

The human Adhr-1 gene, which is approximately 1808 nucleotides in length, encodes a protein having a molecular weight of approximately 41.5 kD and which is approximately 377 amino acid residues in length.

Isolation of the Human 39228 (Adhr-1) cDNA

The invention is based, at least in part, on the discovery of a human gene encoding a novel protein, referred to herein as Adhr-1. The entire sequence of the human clone Fbh39228 was determined and found to contain an open reading frame termed human "Adhr-1." The nucleotide sequence encoding the human Adhr-1 protein is set forth as SEQ ID NO:89. The protein encoded by this nucleic acid comprises about 377 amino acids and has the amino acid sequence set forth as SEQ ID NO:90. The coding region (open reading frame) of SEQ ID NO:89 is set forth as SEQ ID NO:91.

Analysis of the Human 39228 (Adhr-1) Molecule

A search for domain consensus sequences was performed using the amino acid sequence of Adhr-1 and a database of HMMs (the Pfam database, release 2.1) using the default parameters (described above). The search revealed an ADH-Zn domain (Pfam label ADH_ZINC; Pfam Accession Number PS00059) within SEQ ID NO:90 at residues 47-368 and an Lipase-SER domain (Pfam label LIPASE_GDSL-ser; Pfam Accession Number PS01098) within SEQ ID NO:90 at residues 103-189.

A search was performed against the ProDom database resulting in the identification of a portion of the deduced amino acid sequence of human Adhr-1 (SEQ ID NO:90) which has a 27% identity to ProDom Accession Number PD000104 ("Oxidoreductase zinc dehydrogenase alcohol NAD protein family multigene NADP formaldehyde") over residues 54 to 367. In addition, human Adhr-1 is 40% identical to ProDom entry "Quinone oxidoreductase NADPH: quinone NADP reductase zinc protein crystallin zeta-NADPH" over residues 33 to 84.

A search was also performed against the Prosite database, and resulted in the identification of several possible N-glycosylation sites within the human Adhr-1 protein at residues 75-78 and 80-83 of SEQ ID NO:90. In addition, protein kinase C phosphorylation sites were identified within the human Adhr-1 protein at residues 89-91, 112-114, 145-147, 163-165, 193-195, and 362-364 of SEQ ID NO:90. This search also identified casein kinase II phosphorylation sites at residues 128-131, 163-166, 205-208, and 344-347 of human Adhr-1. A tyrosine phosphorylation site motif was also identified in the human Adhr-1 protein at residues 10-17 of SEQ ID NO:90. The search also identified the presence of N-myristoylation site motifs at residues 73-78, 108-113, 118-123, 169-174, 202-207, and 287-292 of SEQ ID NO:90. In addition, the search identified an amidation site at residues 172-175 of SEQ ID NO:90, and a microbody C-terminal targeting signal at residues 375-377 of human Adhr-1.

An analysis of the possible cellular localization of the Adhr-1 protein based on its amino acid sequence was performed using the methods and algorithms described in Nakai and Kanehisa (1992) *Genomics* 14:897-911. The results from this analysis predict that the Adhr-1 protein is found in the peroxisomes, in the cytoplasm, and in the mitochondria.

Tissue Distribution of 39228 mRNA

This example describes the tissue distribution of human ADHR-1 mRNA in a variety of cells and tissues, as determined using the TaqMan® procedure. The TaqMan® procedure is a quantitative, reverse transcription PCR-based approach for detecting mRNA. The RT-PCR reaction exploits the 5' nuclease activity of AmpliTaq Gold™ DNA Polymerase to cleave a TaqMan® probe during PCR. Briefly, cDNA was generated from the samples of interest, e.g., various human tissue samples, and used as the starting material for PCR amplification. In addition to the 5' and 3' gene-specific primers, a gene-specific oligonucleotide probe (complementary to the region being amplified) was included in the reaction (i.e., the TaqMan® probe). The TaqMan® probe includes the oligonucleotide with a fluorescent reporter dye covalently linked to the 5' end of the probe (such as FAM (6-carboxyfluorescein), TET (6-carboxy-4,7,2',7'-tetrachlorofluorescein), JOE (6-carboxy-4,5-dichloro-2,7-dimethoxy-fluorescein), or VIC) and a quencher dye (TAMRA (6-carboxy-N,N,N',N'-tetramethylrhodamine) at the 3' end of the probe.

During the PCR reaction, cleavage of the probe separates the reporter dye and the quencher dye, resulting in increased fluorescence of the reporter. Accumulation of PCR products is detected directly by monitoring the increase in fluorescence of the reporter dye. When the probe is intact, the proximity of the reporter dye to the quencher dye results in suppression of the reporter fluorescence. During PCR, if the target of interest is present, the probe specifically anneals between the forward and reverse primer sites. The 5'-3' nucleolytic activity of the AmpliTaq™ Gold DNA Polymerase cleaves the probe between the reporter and the quencher only if the probe hybridizes to the target. The probe fragments are then displaced from the target, and polymerization of the strand continues. The 3' end of the probe is blocked to prevent extension of the probe during PCR. This process occurs in every cycle and does not interfere with the exponential accumulation of product. RNA was prepared using the trizol method and treated with DNase to remove contaminating genomic DNA. cDNA was synthesized using standard techniques. Mock cDNA synthesis in the absence of reverse transcriptase resulted in samples with no detectable PCR amplification of the control gene confirms efficient removal of genomic DNA contamination.

Expression of ADHR-1 mRNA was upregulated in various tumors, e.g., 100% of lung tumor samples analyzed had a higher level of expression as compared to normal lung tissues. Similarly, the expression of this gene was found to be upregulated in 100% of the prostate tumor samples analyzed, 75% of the colon tumor samples analyzed, 100% of the colon to liver metastasis samples analyzed, 25% of the breast tumor samples analyzed, and 20% of the ovarian tumor samples analyzed, as compared to their normal tissue counterparts.

Expression of Adhr-1 was also detected in tumor derived cell lines such as insulinoma (HepG-2), acute promyelocytic leukemia (HL-60), melanoma (G361), erythroleukemia cells, mast cells (HMC-1), cervical squamous cell carcinomas, ovarian cancer cell lines (e.g., SKOV3Nar which are a variant of the parental SKOV3 ovarian cancer cell line that are cisplatin resistant, A2780, A2780/ADR, OVCAR-3, HEY, MDA2774, and ES2 cell lines). Furthermore, it was found that the expression of Adhr-1 was upregulated in SKOV3/var *cells* when this cell line was treated with the growth factor hergulin, demonstrating that Adhr-1 may be acting in the same signaling pathway as the epidermal growth factor receptor (EGFR) family which includes EGFR, Her2, Her3 and Her4.

Strong expression of Adhr-1 was detected in skeletal muscle tissues and in tissues derived from normal brain cortex. In addition, weak to intermediate expression of Adhr-1 was detected in normal tissues like keratinocytes, mammary gland, thymus, spleen small intestine, retina, retinal pigmentosa epithelia, normal ovarian epithelia, normal megakaryocyte, placenta, aortic endothelial, Th-1 and Th-2-induced T cells, HUVEC (untreated) and HUVEC (hypoxia), and in fetal tissues derived from the heart, kidney, lung, and dorsal spinal chord.

Human 62088

The present invention is based, at least in part, on the discovery of novel molecules, referred to herein as "62088", "nucleoside phosphatase family member-1" or "NPM-1" nucleic acid and polypeptide molecules, which are novel members of the nucleoside phosphatase family. These novel molecules are capable of, for example, modulating a nucleoside phosphatase-mediated activity (e.g., diphosphate and triphosphate hydrolase-mediated activity) in a cell, e.g., a heart, placenta, lung, liver, skeletal muscle, thymus, kidney, pancreas, testis, ovary, prostate, colon, or brain cell.

The family of nucleoside phosphatases includes proteins from a wide array of organisms ranging from peas to toxiplasma, yeast, and mammals (Handa et al. (1996) Biochem. Biophys. Res. Commun. 218:916-923; Vasconcelos et al. (1996) J. Biol. Chem. 271:22139-22145). Members of this family share several very conserved domains and are membrane-bound. These proteins are highly glycosylated and exist as homooligomers (e.g., dimers, trimers, and tetramers). Nucleoside phosphatase members include nucleotide triphosphatases (NTPases, e.g., ATPases, GTPases, and UTPases) and nucleotide diphosphatases (NDPases, e.g., ADPases, GDPases, and UDPases) which function to hydrolyze ATP to ADP, ADP to AMP, GTP to GDP, GDP to GMP, UTP to UDP, and/or UDP to UMP. Enzymes included in this family have a broad tissue distribution and have been identified in heart, placenta, lung, liver, skeletal muscle, thymus, kidney, pancreas, testis, ovary, prostate, colon, and brain tissues (Zimmermann (1999) Trends Pharm. Sci. 20:231-236).

Nucleotides, such as ATP, ADP, GTP, GDP, UTP, and UDP, act as signaling substances in nearly all tissues (Zimmermann, supra). For example, extracellular ATP is though to induce cell permeabilization and cell necrosis or apoptosis, triggering of accumulation of second messengers, and effect cell proliferation (Redegeld (1999) Trends Pharm. Sci. 20:453-459). GTP is thought to induce cell motility and invasion as well as signaling via G proteins (Keely et al. (1998) Trends Cell Biol. 8:101-107; Vale (1999) Trends Biochem. Sci. 24:M38-M42). UTP has been shown to be involved with extracellular signaling, mobilization of intracellular $Ca^{2+}$, and initiation of cytokine production (Lazarowski et al. (1997) J. Biol. Chem. 272:24348-24354; Marriott et al. (1999) Cell Immunol. 195:147-156). Nucleoside phosphatases play an important role in signal transduction via the hydrolysis and subsequent termination of signaling mediated by extracellular nucleotides. In addition to modifying cell signaling, nucleoside phosphatases have also been implicated in protecting the cell from invading organisms by destroying incoming DNA or RNA, inhibiting platelet-mediated thrombotic diatheses, neurotransmission, blood pressure regulation, and slowing the progression of vascular injury (Gao et al. (1999) J. Biol. Chem. 274:21450-21456; Zimmerman, supra).

Several nucleoside phosphatases have been identified to date, including CD39L1 (rat, mouse, human, and chicken) (Zimmerman, supra), CD39L3 (human and chicken) (Zimmerman, supra), CD39 (human, rat, mouse, and bovine) (Birks, et al. (1994) J. Immunol. 153:3574-3583; Zimmerman, supra), S. cerevisiae GDA1 (Abeijon et al. (1993) J. Cell Biol. 122:307-323), T. Gondii NTP1 (Asai et al. (1995) J. Biol. Chem. 270:11391-11397), and pea NTPA (Hsieh et al. (1996) Plant Mol. Biol. 30:135-147).

As used herein, a "nucleoside phosphatase family member" includes a protein or polypeptide which is involved in triphosphate and/or diphosphate hydrolysis and regulation of, e.g., ATP, ADP, GTP, GDP, UTP, and/or UDP. As used herein, the term "nucleoside hydrolysis" includes the dephosphorylation of ATP, ADP, GTP, GDP, UTP, and/or UDP, resulting in the formation of ADP, AMP, GDP, GMP, UDP, and/or UMP or other forms of nucleoside. Nucleoside hydrolysis is mediated by nucleoside phosphatases, e.g., NTPases and NDPases, e.g., ATPases, ADPases, GTPases, GDPases, UTPases, and UDPases. As used herein, the term "regulation of ATP, ADP, GTP, GDP, UTP, and/or UDP levels" includes cellular mechanisms involved in regulating and influencing the levels, e.g., intracellular and/or extracellular levels, of ATP, ADP, GTP, GDP, UTP, and/or UDP. Such mechanisms include the hydrolysis of ATP to ADP, ADP to AMP, GTP to GDP, GDP to GMP, UTP to UDP, and/or UDP to UMP (i.e., nucleoside hydrolysis) in response to biological cues, e.g., by a nucleoside phosphatase. The maintenance of ATP, ADP, GTP, GDP, UTP, and/or UDP levels is particularly important for a cell's signaling needs. Thus, the NPM-1 molecules, by participating in ATP, ADP, GTP, GDP, UTP, and/or UDP hydrolysis and regulation of ADP, AMP, GDP, GMP, UDP, and/or UMP levels, may modulate ATP, ADP, GTP, GDP, UTP, and/or UDP hydrolysis and ADP, AMP, GDP, GMP, UDP, and/or UMP levels and provide novel diagnostic targets and therapeutic agents to control ATP, ADP, GTP, GDP, UTP, and/or UDP hydrolysis-related disorders. As the NPM-1 molecules of the present invention are nucleoside phosphatases modulating nucleoside-phosphatase mediated activities (e.g., diphosphate and triphosphate hydrolase activities), they may also be useful for developing novel diagnostic and therapeutic agents for nucleoside-phosphatase associated disorders (e.g., diphosphate and triphosphate hydrolase associated disorders).

The term "family" when referring to the polypeptide and nucleic acid molecules of the invention is intended to mean two or more polypeptides or nucleic acid molecules having a common structural domain or motif and having sufficient amino acid or nucleotide sequence homology as defined herein. Such family members can be naturally or non-naturally occurring and can be from either the same or different species. For example, a family can contain a first polypeptide of human origin, as well as other, distinct polypeptides of human origin or alternatively, can contain homologues of non-human origin, e.g., mouse or monkey polypeptides. Members of a family may also have common functional characteristics.

For example, the family of NPM-1 polypeptides comprise at least one "transmembrane domain" and preferably two transmembrane domains. As used herein, the term "transmembrane domain" includes an amino acid sequence of about 20-45 amino acid residues in length which spans the plasma membrane. More preferably, a transmembrane domain includes about at least 20, 25, 30, 35, 40, or 45 amino acid residues and spans the plasma membrane. Transmembrane domains are rich in hydrophobic residues, and typically have an alpha-helical structure. In a preferred embodiment, at least 50%, 60%, 70%, 80%, 90%, 95% or more of the amino acids of a transmembrane domain are hydrophobic, e.g., leucines, isoleucines, alanines, valines, phenylalanines, prolines or methionines. Transmembrane domains are described in, for example, Zagotta W. N. et al, (1996) Annual Rev. Neurosci. 19: 235-263, the contents of which are incorporated herein by reference. Amino acid residues 29-47 and 552-570 of the NPM-1 polypeptide (SEQ ID NO:93) comprise transmembrane domains. Accordingly, NPM-1 polypeptides having at least 50-60% homology, preferably about 60-70%, more preferably about 70-80%, or about 80-90% homology with a transmembrane domain of human NPM-1 are within the scope of the invention.

To identify the presence of a transmembrane domain in an NPM-1 protein, and make the determination that a protein of interest has a particular profile, the amino acid sequence of the protein may be subjected to MEMSAT analysis. A MEMSAT analysis resulted in the identification of two transmembrane domains in the amino acid sequence of human NPM-1 (SEQ ID NO:93) at about residues 29-47 and 552-570.

In another embodiment, an NPM-1 molecule of the present invention is identified based on the presence of at least one "nucleoside phosphatase family domain", also referred to interchangeably as an "NTPase domain". As used herein, the term "nucleoside phosphatase family domain" or "NTPase domain" includes a protein domain having an amino acid sequence of about 350-550 amino acid residues and has a bit score of at least 150 when compared against a nucleoside phosphatase Hidden Markov Model (HMM), e.g., a GDA1_CD39 (nucleoside phosphatase) family HMM having PFAM Accession No. PF01150. Preferably, a "nucleoside phosphatase family domain" of "NTPase domain" has an amino acid sequence of about 400-500, 425-475, or more preferably about 461 amino acid residues, and a bit score of at least 200, 250, 300, 320, or more preferably 324.9. In a preferred embodiment, a "nucleoside phosphatase family domain" or "NTPase domain" includes a protein which has an amino acid sequence of about 390-510 amino acid residues, and serves to hydrolyze diphosphate or triphosphate nucleotides, and optionally is an ectoenzymatic domain (e.g., acts extracellularly), and lies between amino- and carboxy-terminal cytoplasmic domains. To identify the presence of a nucleoside phosphatase family domain in an NPM-1 protein, and make the determination that a protein of interest has a particular profile, the amino acid sequence of the protein may be searched against a database of known protein domains (e.g., the HMM database). The nucleoside phosphatase family domain (HMM) has been assigned the PFAM Accession PF01150. A search was performed against the HMM database resulting in the identification of a nucleoside phosphatase family domain in the amino acid sequence of human NPM-1 (SEQ ID NO:93) at about residues 75-536 of SEQ ID NO:93.

A description of the Pfam database can be found in Sonhammer et al. (1997) *Proteins* 28:405-420 and a detailed description of HMMs can be found, for example, in Gribskov et al. (1990) *Meth. Enzymol.* 183:146-159; Gribskov et al. (1987) *Proc. Natl. Acad. Sci. USA* 84:4355-4358; Krogh et al. (1994) *J. Mol. Biol.* 235:1501-1531; and Stultz et al. (1993) *Protein Sci.* 2:305-314, the contents of which are incorporated herein by reference.

In a preferred embodiment, the NPM-1 molecules of the invention include at least one, preferably two, transmembrane domain(s) and/or at least one nucleoside phosphatase family domain.

Isolated polypeptides of the present invention, preferably NPM-1 polypeptides, have an amino acid sequence sufficiently identical to the amino acid sequence of SEQ ID NO:93 or are encoded by a nucleotide sequence sufficiently identical to SEQ ID NO:92 or 94. As used herein, the term "sufficiently identical" refers to a first amino acid or nucleotide sequence which contains a sufficient or minimum number of identical or equivalent (e.g., an amino acid residue which has a similar side chain) amino acid residues or nucleotides to a second amino acid or nucleotide sequence such that the first and second amino acid or nucleotide sequences share common structural domains or motifs and/or a common functional activity. For example, amino acid or nucleotide sequences which share common structural domains having at least 50%, 55%, 60%, 65%, 70%, 75%, 80%, 85%, 85%, 90%, 95%, 96%, 97%, 98%, 99% or more homology or identity across the amino acid sequences of the domains and contain at least one and preferably two structural domains or motifs, are defined herein as sufficiently identical. Furthermore, amino acid or nucleotide sequences which share at least 50%, 55%, 60%, 65%, 70%, 75%, 80%, 85%, 85%, 90%, 95%, 96%, 97%, 98%, 99% or more homology or identity and share a common functional activity are defined herein as sufficiently identical.

In a preferred embodiment, an NPM-1 polypeptide includes at least one or more of the following domains: a transmembrane domain, a nucleoside phosphatase family domain, and has an amino acid sequence at least about 50%, 55%, 60%, 65%, 70%, 75%, 80%, 85%, 85%, 90%, 95%, 96%, 97%, 98%, 99% or more homologous or identical to the amino acid sequence of SEQ ID NO:93. In yet another preferred embodiment, an NPM-1 polypeptide includes at least one or more of the following domains: a transmembrane domain and/or a nucleoside phosphatase family domain, and is encoded by a nucleic acid molecule having a nucleotide sequence which hybridizes under stringent hybridization conditions to a complement of a nucleic acid molecule comprising the nucleotide sequence of SEQ ID NO:92 or SEQ ID NO:94. In another preferred embodiment, an NPM-1 polypeptide includes at least one or more of the following domains: a transmembrane domain, a nucleoside phosphatase family domain, and has an NPM-1 activity.

As used interchangeably herein, an "NPM-1 activity", "biological activity of NPM-1" or "functional activity of NPM-1", refers to an activity exerted by an NPM-1 polypeptide or nucleic acid molecule on an NPM-1 responsive cell or tissue, or on an NPM-1 polypeptide substrate, as determined in vivo, or in vitro, according to standard techniques. In one embodiment, an NPM-1 activity is a direct activity, such as an association with an NPM-1-target molecule. As used herein, a "target molecule" or "binding partner" is a molecule with which an NPM-1 polypeptide binds or interacts in nature, such that NPM-1-mediated function is achieved. An NPM-1 target molecule can be a non-NPM-1 molecule, for example, a non-NPM-1 polypeptide or polypeptide. In an exemplary embodiment, an NPM-1 target molecule is an NPM-1 ligand, e.g., a nucleoside phosphatase family domain ligand e.g., nucleoside triphosphates and/or nucleoside diphosphates. For example, an NPM-1 target molecule can have one or more of the following activities: (1) interact with nucleotide triphosphates (e.g., ATP, GTP, UTP, and the like) (2) interact with nucleoside diphosphates (e.g., ADP, GDP, UDP, and the like), (3) hydrolysis of nucleoside triphosphates (e.g., ATP, GTP, UTP, and the like), (4) hydrolysis of nucleoside diphosphates (e.g., ADP, GDP, UDP, and the like), and (5) interact with and/or hydrolysis of thiamine pyrophosphate. Alternatively, an NPM-1 activity is an indirect activity, such as a cellular signaling activity mediated by interaction of the NPM-1 polypeptide with an NPM-1 ligand. The biological activities of NPM-1 are described herein. For example, the NPM-1 polypeptides of the present invention can have one or more of the following activities: (1) hydrolyze nucleoside triphosphates, (2) hydrolyze nucleoside diphosphates, (3) modulate signal transduction, (4) modulate neurotransmission and neuromodulation (e.g., in the central and peripheral nervous systems), (5) modulate tumor inhibition, (6) modulate endocrine gland secretion, (7) modulate platelet aggregation, (8) modulate Cl⁻ transport (e.g., in airway epithelia), (9) modulate renal function, (10) modulate molecular motor function, (11) modulate cytoskeletal organization, (12) modulate vesicle transport, (13) participate in nociception, (14) modulate cellular growth and/or proliferation, and (15) modulate angiogenesis.

Accordingly, another embodiment of the invention features isolated NPM-1 polypeptides and polypeptides having an NPM-1 activity. Preferred polypeptides are NPM-1 polypeptides having at least one or more of the following domains: a transmembrane domain, a nucleoside phosphatase family domain, and, preferably, an NPM-1 activity.

Additional preferred polypeptides have one or more of the following domains: a transmembrane domain and/or a nucleoside phosphatase family domain, and are, preferably, encoded by a nucleic acid molecule having a nucleotide sequence which hybridizes under stringent hybridization conditions to a complement of a nucleic acid molecule comprising the nucleotide sequence of SEQ ID NO:92 or 94.

The nucleotide sequence of the isolated human NPM-1 cDNA and the predicted amino acid sequence of the human NPM-1 polypeptide are shown in SEQ ID NOs:92 and 93, respectively. The human NPM-1 gene, which is approximately 3296 nucleotides in length, encodes a polypeptide which is approximately 604 amino acid residues in length.

Isolation of the Human 62088 (NPM-1) cDNA

The invention is based, at least in part, on the discovery of a human gene encoding a novel polypeptide, referred to herein as human NPM-1. The entire sequence of the human clone 62088 was determined and found to contain an open reading frame termed human "NPM-1." The nucleotide sequence of the human NPM-1 gene is set forth in the Sequence Listing as SEQ ID NO:92. The amino acid sequence of the human NPM-1 expression product is set forth in the Sequence Listing as SEQ ID NO: 93. The NPM-1 polypeptide comprises about 604 amino acids. The coding region (open reading frame) of SEQ ID NO:92 is set forth as SEQ ID NO:94.

Analysis of the Human 62088 (NPM-1) Molecules

A search using the polypeptide sequence of SEQ ID NO:93 was performed against the HMM database in PFAM resulting in the identification of a nucleoside phosphatase family domain in the amino acid sequence of human NPM-1 at about residues 75-536 of SEQ ID NO:93 (score=324.9).

A search using the polypeptide sequence of SEQ ID NO:93 was also performed against the Memsat database, resulting in the identification of three potential transmembrane domains in the amino acid sequence of human NPM-1 (SEQ ID NO:93) at about residues 29-47, 84-102, and 552-570, and the identification of a potential signal peptide in the amino acid sequence of human NPM-1 at about residues 1-54 of SEQ ID NO:93.

The second predicted transmembrane domain (i.e., amino acids 84-102 of SEQ ID NO:93) having a score of 0.7 is not presumed to be a physiological domain based on the low score and on further analysis of NPM-1 as a nucleoside phosphatase family member. Members of the family (e.g., CD39) typically contain two transmembrane domains and a large ectoplasmic domain.

The predicted signal peptide (i.e., within the region of amino acids 1-54 of SEQ ID NO:93) falls within the region of the first predicted transmembrane domain (i.e., amino acids 29-47 of SEQ ID NO:93) and is not presumed to be a physiological domain based on its location within the first transmembrane domain, analogy to nucleoside phosphatase family members, and analogy to signal anchor sequences. A signal peptide (e.g., TNF) may function not as a cleavable signal sequence but, instead, serve as a signal anchor sequence.

The amino acid sequence of human NPM-1 was analyzed using the program PSORT to predict the localization of the proteins within the cell. This program assesses the presence of different targeting and localization amino acid sequences within the query sequence. The results of the analyses show that human NPM-1 may be localized to the mitochondria, endoplasmic reticulum, or to the nucleus.

Searches of the amino acid sequence of human NPM-1 were further performed against the Prosite database. These searches resulted in the identification in the amino acid sequence of human NPM-1 of a number of potential N-glycosylation sites, a potential protein kinase C phosphorylation site, a number of potential protein kinase C phosphorylation sites, a number of potential casein kinase II phosphorylation sites, a potential tyrosine kinase phosphorylation site, a number of potential N-myristoylation sites, a potential amidation site, a potential prokaryotic membrane lipoprotein lipid attachment site, and a potential cell attachment sequence.

Further hits were identified by using the amino acid sequence of NPM-1 (SEQ ID NO:93) to search through the ProDom database. Numerous matches against proteins and/or protein domains described as "lysosomal apyrase-like plasmid LALP1 guanosine-diphosphatase hydrolase", "hydrolase lysosomal apyrase-like chromosome transmembrane", "hydrolase antigen transmembrane apyrase ecto-ATPase glycoprotein ATP-diphosphohydrolase nucleoside lymphoid", "antigen hydrolase ecto-ATPase transmembrane glycoprotein ATP-diphosphohydrolase activation lymphoid vascular", "lysosomal apyrase-like plasmid LALP1 guanosine-diphosphatase hydrolase", "chromosome transmembrane hydrolase X", and "hydrolase nucleoside-triphosphatase multigene family triphosphate NTPase precursor signal II", and the like were identified.

Tissue Distribution of 62088 mRNA

This example describes the tissue distribution of human NPM-1 mRNA in a variety of cells and tissues, as determined using the TaqMan® procedure. The TaqMan® procedure is a quantitative, reverse transcription PCR-based approach for detecting mRNA. The RT-PCR reaction exploits the 5' nuclease activity of AmpliTaq Gold™ DNA Polymerase to cleave a TaqMan® probe during PCR. Briefly, cDNA was generated from the samples of interest, e.g., various tumor and normal tissue samples, and used as the starting material for PCR amplification. In addition to the 5' and 3' gene-specific primers, a gene-specific oligonucleotide probe (complementary to the region being amplified) was included in the reaction (i.e., the TaqMan® probe). The TaqMan® probe includes the oligonucleotide with a fluorescent reporter dye covalently linked to the 5' end of the probe (such as FAM (6-carboxyfluorescein), TET (6-carboxy-4,7,2',7'-tetrachlorofluorescein), JOE (6-carboxy-4,5-dichloro-2,7-dimethoxyfluorescein), or VIC) and a quencher dye (TAMRA (6-carboxy-N,N,N',N'-tetramethylrhodamine) at the 3' end of the probe.

During the PCR reaction, cleavage of the probe separates the reporter dye and the quencher dye, resulting in increased fluorescence of the reporter. Accumulation of PCR products is detected directly by monitoring the increase in fluorescence of the reporter dye. When the probe is intact, the proximity of the reporter dye to the quencher dye results in suppression of the reporter fluorescence. During PCR, if the target of interest is present, the probe specifically anneals between the forward and reverse primer sites. The 5'-3' nucleolytic activity of the AmpliTaq™ Gold DNA Polymerase cleaves the probe between the reporter and the quencher only if the probe hybridizes to the target. The probe fragments are then displaced from the target, and polymerization of the strand continues. The 3' end of the probe is blocked to prevent extension of the probe during PCR. This process occurs in every cycle and does not interfere with the exponential accumulation of product. RNA was prepared using the trizol method and treated with DNase to remove contaminating genomic DNA. cDNA was synthesized using standard techniques. Mock cDNA synthesis in the absence of reverse transcriptase resulted in samples with no detectable PCR amplification of the control gene confirms efficient removal of genomic DNA contamination.

An array of human tissues were tested. The results of one such analysis are depicted in Table 16. NPM-1 expression was strong in astrocytes and coronary smooth muscle cells from normal tissues, and was elevated in early aortic smooth muscle cells, shear HUVEC, static HUVEC, and prostate epithelial cells from normal tissues.

TABLE 16

Human NPM-1 TaqMan ® Data

| Tissue Type | Mean | β 2 Mean | ∂∂ Ct | Expression |
|---|---|---|---|---|
| Artery normal | 40 | 22.32 | 17.68 | 0 |
| Vein normal | 40 | 21.32 | 18.68 | 0 |
| Aortic SMC EARLY | 29.98 | 22.62 | 7.36 | 6.0872 |
| Coronary SMC | 29.98 | 23.89 | 6.09 | 14.731 |
| Static HUVEC | 29.59 | 21.26 | 8.34 | 3.0968 |
| Shear HUVEC | 28.86 | 21.55 | 7.32 | 6.2584 |
| Heart normal | 32.98 | 19.4 | 13.58 | 0.0817 |
| Heart CHF | 39.98 | 20.07 | 19.91 | 0 |
| Kidney | 30.55 | 21.14 | 9.41 | 1.47 |
| Skeletal Muscle | 40 | 22.4 | 17.61 | 0 |
| Adipose normal | 40 | 20.63 | 19.37 | 0 |
| Pancreas | 31.95 | 22.45 | 9.49 | 1.3907 |
| primary osteoblasts | 33.91 | 20.19 | 13.73 | 0.0739 |
| Osteoclasts (diff) | 36.52 | 18.56 | 17.97 | 0 |
| Skin normal | 38.36 | 22.01 | 16.35 | 0 |
| Spinal cord normal | 40 | 20.41 | 19.59 | 0 |
| Brain Cortex normal | 32.13 | 21.99 | 10.15 | 0.8832 |
| Brain Hypothalamus normal | 40 | 22.25 | 17.75 | 0 |
| Nerve | 40 | 24.47 | 15.54 | 0 |
| DRG (Dorsal Root Ganglion) | 40 | 22.59 | 17.41 | 0 |
| Glial Cells (Astrocytes) | 28.46 | 22.9 | 5.57 | 21.1236 |
| Glioblastoma | 40 | 18.32 | 21.68 | 0 |
| Breast normal | 40 | 21.66 | 18.34 | 0 |
| Breast tumor | 38.72 | 19.13 | 19.59 | 0 |
| Ovary normal | 35.84 | 21.06 | 14.79 | 0 |
| Ovary Tumor | 39.88 | 20.77 | 19.11 | 0 |
| Prostate Normal | 39.52 | 20.31 | 19.21 | 0 |
| Prostate Tumor | 38.94 | 18.32 | 20.62 | 0 |
| Epithelial Cells (Prostate) | 29.85 | 21.74 | 8.11 | 3.6195 |
| Colon normal | 34.2 | 19.26 | 14.94 | 0.0318 |
| Colon Tumor | 29.68 | 19.56 | 10.12 | 0.9017 |
| Lung normal | 37.66 | 19.2 | 18.47 | 0 |
| Lung tumor | 30.59 | 19.09 | 11.51 | 0.3441 |
| Lung COPD | 39.99 | 19.58 | 20.41 | 0 |
| Colon IBD | 37.73 | 19.22 | 18.52 | 0 |
| Liver normal | 33.96 | 21.09 | 12.88 | 0.1331 |
| Liver fibrosis | 33.37 | 22.85 | 10.52 | 0.6834 |
| Dermal Cells-fibroblasts | 31.61 | 21.57 | 10.05 | 0.9466 |
| Spleen normal | 40 | 20.22 | 19.79 | 0 |
| Tonsil normal | 36.46 | 17.95 | 18.52 | 0 |
| Lymph node | 40 | 19.47 | 20.53 | 0 |
| Small Intestine | 30.55 | 20.52 | 10.03 | 0.9565 |
| Skin-Decubitus | 35.11 | 21.52 | 13.6 | 0 |
| Synovium | 40 | 21.25 | 18.75 | 0 |
| BM-MNC (Bone marrow mononuclear cells) | 28.32 | 17.54 | 10.78 | 0.5707 |
| Activated PBMC | 37.41 | 16.7 | 20.71 | 0 |

Increased expression of NPM-1 was observed in tumors of the breast, lung, and colon as compared to normal breast, lung, and colon tissues. Furthermore, NPM-1 expression was observed in both normal ovary tissue samples as well as ovary tissue samples derived from tumors. The results of such analyses are depicted in Tables 17-20 below.

TABLE 17

NPM-1 Expression In Clinical Breast Samples

| | Average 62088 | Average Beta 2 | Relative Expression |
|---|---|---|---|
| Breast N | 35.9 | 22.5 | 0.36 |
| Breast N | 39.5 | 21.2 | 0.01 |
| Breast N | 34.5 | 17.6 | 0.03 |
| Breast N | 34.0 | 19.4 | 0.16 |
| Breast T | 29.5 | 17.7 | 1.10 |
| Breast T | 30.2 | 17.9 | 0.81 |
| Breast T | 27.3 | 16.9 | 2.75 |
| Breast T | 31.2 | 19.9 | 1.55 |
| Breast T | 30.8 | 18.6 | 0.85 |
| Breast T | 29.2 | 19.7 | 5.51 |

TABLE 18

NPM-1 Expression In Clinical Lung Samples

| | Average 62088 | Average Beta 2 | Relative Expression |
|---|---|---|---|
| Lung N | 32.0 | 17.0 | 0.12 |
| Lung N | 35.4 | 19.0 | 0.05 |
| Lung N | 28.8 | 16.2 | 0.64 |
| Lung N | 34.3 | 16.3 | 0.02 |
| Lung T | 24.7 | 16.2 | 11.40 |
| Lung T | 26.4 | 17.1 | 6.62 |
| Lung T | 26.7 | 18.2 | 10.31 |
| Lung T | 28.4 | 16.9 | 1.38 |
| Lung T | 27.3 | 18.7 | 10.53 |
| Lung T | 27.6 | 19.1 | 10.78 |
| Lung T | 25.7 | 17.5 | 13.05 |

TABLE 19

NPM-1 Expression In Clinical Colon Samples

| | Average 62088 | Average Beta 2 | Relative Expression |
|---|---|---|---|
| Colon N | 36.1 | 22.4 | 0.8 |
| Colon N | 33.2 | 18.4 | 0.4 |
| Colon N | 28.5 | 18.0 | 7.8 |
| Colon N | 30.4 | 16.4 | 0.7 |
| Colon T | 28.8 | 16.1 | 1.7 |
| Colon T | 29.8 | 17.4 | 2.1 |
| Colon T | 28.8 | 15.9 | 1.4 |
| Colon T | 27.2 | 16.7 | 7.8 |
| Colon T | 29.5 | 16.3 | 1.2 |
| Colon T | 28.1 | 15.7 | 2.1 |
| Liver Met | 28.1 | 17.1 | 5.2 |
| Liver Met | 28.3 | 19.1 | 19.2 |
| Liver Met | 26.2 | 17.2 | 21.9 |
| Liver Met | 28.1 | 17.3 | 6.0 |
| Liver Nor | 26.3 | 16.2 | 10.1 |
| Liver Nor | 31.8 | 22.4 | 15.8 |

TABLE 20

NPM-1 Expression In Clinical Ovary Samples

|  | Average 62088 | Average Beta 2 | Relative Expression |
|---|---|---|---|
| Ovary N | 28.5 | 17.9 | 2.60 |
| Ovary N | 33.0 | 19.4 | 0.33 |
| Ovary N | 35.4 | 22.5 | 0.53 |
| Ovary T | 31.3 | 18.5 | 0.55 |
| Ovary T | 29.1 | 18.0 | 1.75 |
| Ovary T | 29.4 | 17.1 | 0.76 |
| Ovary T | 32.0 | 17.9 | 0.24 |
| Ovary T | 31.8 | 17.5 | 0.19 |
| Ovary T | 32.4 | 19.2 | 0.43 |
| Ovary T | 32.2 | 20.3 | 1.03 |
| Ovary T | 31.5 | 16.7 | 0.14 |

To further investigate the observed increase in NPM-1 expression in cancerous tissue, NPM-1 expression levels were measured in various angiogenesis samples by quantitative PCR using the TaqMan® procedure as described above. The relative levels of NPM-1 expression in various tissue samples is depicted in Table 21 below.

TABLE 21

NPM-1 Expression In Clinical Angiogenic Samples

|  | 62088 | Beta 2 | Expression |
|---|---|---|---|
| Brain N | 29.6 | 19.6 | 10.2 |
| Brain N | 29.1 | 20.5 | 27.5 |
| Astrocyt | 27.5 | 21.1 | 125.0 |
| Brain T | 29.1 | 16.4 | 1.6 |
| Brain T | 28.2 | 16.1 | 2.6 |
| Brain T | 29.2 | 16.2 | 1.4 |
| Brain T | 28.7 | 16.9 | 3.2 |
| Brain T | 33.8 | 18.7 | 0.3 |
| HMVEC | 24.3 | 16.0 | 34.1 |
| HMVEC | 24.0 | 16.5 | 62.7 |
| Placenta | 30.8 | 22.2 | 29.8 |
| Fetal Adrenal | 31.9 | 23.4 | 29.0 |
| Fetal Adrenal | 28.2 | 23.1 | 320.9 |
| Fetal Liver | 28.1 | 19.1 | 21.3 |
| Fetal Liver | 29.2 | 18.0 | 4.7 |

Expression was greatest in astrocytes, and high in HMVEC, placental, fetal adrenal, fetal liver, and normal brain tissue samples.

To further investigate the expression of NPM-1 in tumorigenic cells, NPM-1 expression levels were measured in various cell types suitable for animal transplantation by quantitative PCR using the TaqMan® procedure as described above. The relative levels of NPM-1 expression in various samples is depicted in Table 22 below.

TABLE 22

Human NPM-1 Taqman Data In Xenograft Cells

|  | Average 62088 | Average 18S | Relative Expression |
|---|---|---|---|
| MCF-7 | 28.81 | 12.01 | 0.44 |
| ZR75 | 27.87 | 9.87 | 0.19 |
| T47D | 27.83 | 11.11 | 0.46 |
| MDA 231 | 28.97 | 10.30 | 0.12 |
| MDA 435 | 28.07 | 11.12 | 0.40 |
| DLD-1 | 28.33 | 10.55 | 0.22 |
| SW 480 | 30.49 | 11.11 | 0.07 |
| SW 620 | 27.93 | 10.66 | 0.32 |
| HCT 116 | 27.38 | 9.52 | 0.21 |
| HT 29 | 27.85 | 11.00 | 0.43 |
| Colo 205 | 25.90 | 9.10 | 0.44 |
| NCIH 125 | 27.64 | 10.05 | 0.26 |
| NCIH 67 | 27.21 | 7.66 | 0.07 |
| NCIH 322 | 28.71 | 11.33 | 0.29 |
| NCIH 460 | 27.32 | 8.84 | 0.14 |
| A549 | 28.19 | 9.47 | 0.12 |
| NHBE | 27.94 | 8.65 | 0.08 |

Notably, NPM-1 expression was highest in the human breast cancer cell lines MCF-7, T47D, and MDA 435, and the human colon cancer cell lines HT29, and Colo 205. Expression was also elevated in the human colon cancer cell line DLD-1, the human breast cancer cell line SW 620, and the human lung cancer cell lines NCIH 125 and NCIH 322.

Tissue Distribution of 62088 (NPM-1) by In Situ Analysis

This example describes the tissue distribution of human NPM-11 mRNA, as determined by in situ hybridization analysis using oligonucleotide probes based on the human NPM-1 sequence.

For in situ analysis, various tissues, e.g. tissues obtained from lung, ovary, colon, and breast, were first frozen on dry ice. Ten-micrometer-thick sections of the tissues were then postfixed with 4% formaldehyde in DEPC treated 1× phosphate-buffered saline at room temperature for 10 minutes before being rinsed twice in DEPC 1× phosphate-buffered saline and once in 0.1 M triethanolamine-HCl (pH 8.0). Following incubation in 0.25% acetic anhydride-0.1 M triethanolamine-HCl for 10 minutes, sections were rinsed in DEPC 2×SSC (1×SSC is 0.15M NaCl plus 0.015M sodium citrate). Tissue was then dehydrated through a series of ethanol washes, incubated in 100% chloroform for 5 minutes, and then rinsed in 100% ethanol for 1 minute and 95% ethanol for 1 minute and allowed to air dry.

Hybridizations were performed with $^{35}$S-radiolabeled ($5 \times 10^7$ cpm/ml) cRNA probes. Probes were incubated in the presence of a solution containing 600 mM NaCl, 10 mM Tris (pH 7.5), 1 mM EDTA, 0.01% sheared salmon sperm DNA, 0.01% yeast tRNA, 0.05% yeast total RNA type X1, 1×Denhardt's solution, 50% formamide, 10% dextran sulfate, 100 mM dithiothreitol, 0.1% sodium dodecyl sulfate (SDS), and 0.1% sodium thiosulfate for 18 hours at 55° C.

After hybridization, slides were washed with 2×SSC. Sections were then sequentially incubated at 37° C. in TNE (a solution containing 10 mM Tris-HCl (pH 7.6), 500 mM NaCl, and 1 mM EDTA), for 10 minutes, in TNE with 10 µg of RNase A per ml for 30 minutes, and finally in TNE for 10 minutes. Slides were then rinsed with 2×SSC at room temperature, washed with 2×SSC at 50° C. for 1 hour, washed with 0.2×SSC at 55° C. for 1 hour, and 0.2×SSC at 60° C. for 1 hour. Sections were then dehydrated rapidly through serial ethanol-0.3 M sodium acetate concentrations before being air dried and exposed to Kodak Biomax MR scientific imaging film for 24 hours and subsequently dipped in NB-2 photoemulsion and exposed at 4° C. for 7 days before being developed and counter stained.

As depicted in Tables 23 and 24 below, the in situ hybridization results essentially agreed with the results of the TaqMan® analysis. In situ hybridization data with probe e/f indicated weak expression in a lung tumor. Normal and malignant epithelium of the breast, colon, and ovary were negative for NPM-1 expression. In situ hybridization data with probe a/b indicated weak but specific expression in breast tumors (DCIS and IDC), positive expression in a subset of ovary tumors, and was negative for normal and malignant epithelium of the colon.

TABLE 23

Human NPM-1 In Situ Hybridization Data (Probe E/F)

| Specimen # | Tissue | Diagnosis | Results |
|---|---|---|---|
| LUNG: 0/2 normal; 1/3 tumor | | | |
| CHT 457 | Lung | normal | (−) |
| CHT 213 | Lung | normal | (−) |
| CHT 799 | Lung | tumor: NSCCL [SCC] | (−) |
| CHT 344 | Lung | tumor: WD/MD SCC | (−) |
| CHT 846 | Lung | tumor: NSCCL [SCC] | (+) |
| BREAST: 0/3; 0/3 tumor | | | |
| CHT 561 | Breast | normal | (−) |
| PIT 723 | Breast | normal | (−) |
| PIT 34 | Breast | normal | (−) |
| NDR 137 | Breast | tumor: DCIS/hyperplasia | (−) |
| NDR 16 | Breast | tumor: IDC | (−) |
| MDA 91 | Breast | tumor: IDC/ILC | (−) |
| COLON: 0/1 normal; 0/1 tumor | | | |
| NDR 118 | Colon | normal | (−) |
| CHT 372 | Colon | tumor | (−) |
| OVARY: 0/2 normal; 0/3 tumor | | | |
| MDA 203 | Ovary | normal | (−) |
| MDA 197 | Ovary | normal | (−) |
| MDA 62 | Ovary | tumor: PD-PS | (−) |
| MDA 29 | Ovary | tumor: LMP-PS | (−) |
| MDA 210 | Ovary | tumor: PD-PS | (−) |

TABLE 24

Human NPM-1 In Situ Hybridization Data (Probe A/B)

| Specimen # | Tissue | Diagnosis | Results |
|---|---|---|---|
| BREAST: 0/1 normals; 2/2 tumors | | | |
| PIT 35 | Breast | normal | (−) |
| NDR 6 | Breast | tumor: IDC | (+) |
| CLN 186 | Breast | tumor: DCIS/IDC | (+) |
| COLON: 0/2 normals; 0/1 tumor; 0/1 metastasis | | | |
| CHT 231 | Colon | normal | (−) |
| CHT 818 | Colon | normal | (−) |
| CHT 907 | Colon | tumor | (−) |
| CHT 77 | Colon | metastasis | (−) |
| OVARY: 0/2 normals; 1/3 tumors | | | |
| MDA 202 | Ovary | normal | (−) |
| MDA 217 | Ovary | normal | (−) |
| CLN 5 | Ovary | tumor: MD-PS | (−) |

TABLE 24-continued

Human NPM-1 In Situ Hybridization Data (Probe A/B)

| Specimen # | Tissue | Diagnosis | Results |
|---|---|---|---|
| CLN 346 | Ovary | tumor: LMP-mucinous | (−) |
| MDA 300 | Ovary | tumor: MD-AC [endometrioid] | (+) |

Accordingly, 62088 proteins may mediate various disorders, including cellular proliferative and/or differentiative disorders, prostate disorders, colon disorders, lung disorders, ovarian disorders, breast disorders and heart disorders.

Human 46745

The human 46745 sequence (SEQ ID NO:95), which is approximately 2090 nucleotides long including untranslated regions, contains a predicted methionine-initiated coding sequence of about 1605 nucleotides (nucleotides 129-1733 of SEQ ID NO:95; SEQ ID NO:97). The coding sequence encodes a 534 amino acid protein (SEQ ID NO:96). Processed forms, e.g., where initial sequences, e.g., the initial 18 amino acid residues are removed are included.

The gene encoding 46745 maps to human chromosome 5, near D5S678.

Human 46745 contains the following regions or other structural features: a predicted acyltransferase domain (PFAM Accession PF01553) located at about amino acid residues 120-305 of SEQ ID NO:96; and a predicted transmembrane domain which extends from about amino acid residue 46-69 of SEQ ID NO:96.

The 46745 protein also includes the following domains: one predicted N-glycosylation site (PS00001) located at about amino acids 213-216 of SEQ ID NO:96; one glycosaminoglycan attachment site (PS00002) located at about amino acids 394-397 of SEQ ID NO:96; one cAMP- and cGMP-dependent protein kinase phosphorylation site (PS00004) located at about amino acids 183-186 of SEQ ID NO:96; four predicted Protein Kinase C phosphorylation sites (PS00005) located at about amino acids 182-184, 212-214, 219-221, and 356-358 of SEQ ID NO:96; twelve predicted Casein Kinase II phosphorylation sites (PS00006) located at about amino acids 137-140, 176-179, 186-189, 278-281, 305-308, 310-313, 389-392, 435-438, 455-458, 472-475, 496-499, and 500-503 of SEQ ID NO:96; one predicted tyrosine kinase phosphorylation site (PS00007) located at about amino acids 347-355 of SEQ ID NO:96; three predicted N-myristoylation sites (PS00008) located at about amino acids 17-22, 209-214, and 303-308 of SEQ ID NO:96; one predicted amidation site (PS00009) located at about amino acids 524-527 of SEQ ID NO:96; and one predicted dileucine motif in the tail located at about amino acids 23-24 of SEQ ID NO:96.

46745 polypeptides of the invention include fragments which include: all or part of a hydrophobic sequence, e.g., the sequence of 445-460 of SEQ ID NO:96; all or part of a hydrophilic sequence, e.g., the sequence of 180-200 of SEQ ID NO:96; a sequence which includes a Cys, or a glycosylation site.

For general information regarding PFAM identifiers, PS prefix and PF prefix domain identification numbers, refer to Sonnhammer et al. (1997) *Protein* 28:405-420.

TABLE 25

Summary of Domains of 46745

| Protein | Acyltransferase | Transmembrane |
|---|---|---|
| 46745 | About amino acids 120-305 of SEQ ID NO: 96 | About amino acids 46-69 of SEQ ID NO: 96 |

The 46745 protein contains a significant number of structural characteristics in common with members of the acyltransferase family. The term "family" when referring to the protein and nucleic acid molecules of the invention means two or more proteins or nucleic acid molecules having a common structural domain or motif and having sufficient amino acid or nucleotide sequence homology as defined herein. Such family members can be naturally or non-naturally occurring and can be from either the same or different species. For example, a family can contain a first protein of human origin as well as other distinct proteins of human origin, or alternatively, can contain homologues of non-human origin, e.g., rat or mouse proteins. Members of a family can also have common functional characteristics.

Acyltransferases include a superfamily of enzymes that participate in phospholipid biosynthesis. Acyltransferases catalyze the transfer of an acyl chain to a lipid precursor and have been grouped into several subfamilies based upon their target specificity: lysophosphatidic acid acyltransferase (1-acyl-sn-glycerol-3-phosphate acyltransferase; LPAAT); sn-glycerol-3-phosphate acyltransferase (GPAT); acyl-CoA:dihydroxyacetone-phosphate acyltransferase (DHAPAT); and 2-acylglycerophosphatidylethanolamine acyltransferase (LPEAT). Acyltransferases generally contain four regions of conserved amino acid residues, suggesting that these may be domains relevant to the catalytic activity of the enzymes (Lewin et al. (1999) Biochemistry 38:5764-71).

GPAT catalyzes the initial reaction in the pathway of glycerolipid biosynthesis, the transfer of an activated fatty acyl chain to the sn-1 position of glycerol 3-phosphate. LPAAT converts lysophosphatidic acid (LPA) into phosphatidic acid (PA) in the course of lipid metabolism in the ER (Eberhardt et al. (1997) J Biol Chem 272:20299-20305). LPAAT catalyses the transfer of an acyl chain from either acyl-coenzyme A or acyl-acyl carrier protein onto LPA, an intermediate in de novo lipid biosynthesis, to produce PA, the precursor of all glycerolipids. PA can either be hydrolyzed to yield diacylglycerol (DAG) or can be converted to CDP-DAG for the synthesis of more complex phospholipids in the ER. Two human cDNAs have been cloned that encode enzymes having LPAAT activity, LPAAT-α and LPAAT-β (West et al. (1997) DNA Cell Biol 16:691-701; Eberhardt et al. (1997) J Biol Chem 272:20299-20305; Aguado and Campbell (1998) J Biol Chem 273:4096-4105). Both human LPAATs localize to the ER. LPAAT-α and LPAAT-β are encoded by genes located on chromosomes 6 and 9, respectively.

Aside from its role in the formation of biological membranes, LPA is produced by activated platelets and functions as a bioactive mediator, stimulating platelet aggregation, cell proliferation, cell migration, and cell proliferation (Lee et al. (2000) Am J Physiol Cell Physiol 278:612-18). LPA generated in the plasma membrane of activated platelets and growth factor-stimulated fibroblasts appears to arise from hydrolysis of PA by a phospholipase A2. One possible means of the attenuation of the bioactive effects of LPA is acylation by LPAAT to yield PA. PA also has been implicated as an intracellular messenger, suggesting that its generation via acylation of LPA by LPAAT at an inflammatory site may lead to further cellular activation (Eberhardt et al. (1999) Adv Exp Med Biol 469:351-356).

Several specific acyltransferases have been found to participate in critical biological functions. Endophilin 1, an SH3 domain-containing LPAAT, mediates the formation of synaptic-like microvesicles (SLMVs) from the plasma membrane via the conversion of LPA to PA (Schmidt et al. (1999) Nature 401:133-141). Barth syndrome is associated with mutations in a gene that encodes, by means of alternate splicing, several putative acyltransferases known as tafazzins. Barth syndrome is characterized by short stature, cardioskeletal myopathy, neutropenia, abnormal mitochondria, and respiratory-chain dysfunction (Bione et al. (1996) Nature Genetics 12: 385-389).

A 46745 polypeptide can include an "acyltransferase domain" or regions homologous with an "acyltransferase domain".

As used herein, the term "acyltransferase" refers to a protein or polypeptide which is capable of catalyzing an acylation reaction. Acyltransferases can have a specificity for (i.e., a specificity to attach an acyl chain) various lipid precursors. Acyltransferases can be divided into several subfamilies based upon their target specificity, e.g.: lysophosphatidic acid acyltransferase (1-acyl-sn-glycerol-3-phosphate acyltransferase; LPAAT); sn-glycerol-3-phosphate acyltransferase (GPAT); acyl-CoA:dihydroxyacetone-phosphate acyltransferase (DHAPAT); and 2-acylglycerophosphatidylethanolamine acyltransferase (LPEAT). As referred to herein, acyltransferases preferably include a catalytic domain of about 100-250 amino acid residues in length, preferably about 130-200 amino acid residues in length, or more preferably about 160-200 amino acid residues in length. An acyltransferase domain typically includes at least one amino acid found in each of the four blocks of homology commonly found in members of the acyltransferase family. The four blocks are each characterized by the following motifs: (1) [NX]-H-[RQ]-S-X-[LYIM]-D, SEQ ID NO:99; (2) G-X-[IF]-F-I-[RD]-R, SEQ ID NO:100; (3) F-[PLI]-E-G-[TG]-R-[SX]-[RX], SEQ ID NO:101; and (4) [VI]-[PX]-[IVL]-[IV]-P-[VI], SEQ ID NO:102. For example, 46745 contains some residues typically found in these blocks of homology. The 46745 polypeptide of SEQ ID NO:96 has the following sequence in regions corresponding to the four blocks of homology: (1) P-H-S-S-Y-F-D, SEQ ID NO:103; (2) R-P-V-F-V-S-R, SEQ ID NO:104; (3) F-P-E-G-T-C-T-N, SEQ ID NO:105; and (4) A-P-V-Q-P-V, SEQ ID NO:106. Specificity of an acyltransferase for acylation of a particular lipid target can be predicted by the presence of particular sequences within the four blocks, wherein particular amino acid residues are associated with specific classes of acyltransferases (as described in, e.g., Lewin et al. (1999) Biochemistry 38:5764-71, the contents of which are incorporated herein by reference). Based on the sequence similarities, the 46745 molecules of the present invention are predicted to have similar biological activities as acyltransferase family members.

Acyltransferases play a role in diverse cellular processes. For example, the biosynthesis of complex lipids involves specific acylation reactions catalyzed by acyltransferases. These reactions are important for the formation of both storage lipids, triacylglycerols, as well as structural lipids such as phospholipids and galactolipids. Acyltransferases also participate in signaling by regulating the levels of lipids that function as signaling molecules in diverse cellular processes. For example, LPAAT converts LPA to PA, both of which have the capacity to mediate signaling between and within cells. Thus, the molecules of the present invention may be involved in: 1) the transfer of an acyl chain to a lipid precursor; 2) the regulation of lipid biosynthesis; 3) the regulation of wound healing; 4) the regulation of platelet aggregation; 5) the modulation of mitogenesis; 6) the modulation of cellular differentiation; 7) the modulation of actin cytoskleleton remodeling; 8) the regulation of monocyte chemotaxis; 9) the modulation of neurite retraction; 10) the modulation of vasoconstriction; 11) the modulation of glutamate and glucose uptake by astrocytes; 12) the modulation of tumor cell growth and invasion; 13) the formation of synaptic-like microvesicles; and 14) the modulation of cellular proliferation.

As used herein, the term "acyltransferase domain" includes an amino acid sequence of about 80-300 amino acid residues in length and having a bit score for the alignment of the sequence to the acyltransferase domain (HMM) of at least 15. Preferably, an acyltransferase domain includes at least about 100-250 amino acids, more preferably about 130-200 amino acid residues, or about 160-200 amino acids and has a bit score for the alignment of the sequence to the acyltransferase domain (HMM) of at least 30 or greater. The acyltransferase domain (HMM) has been assigned the PFAM Accession PF0155. A search was performed against the HMM database resulting in the identification of a "acyltransferase" domain in the amino acid sequence of human 46745 at about residues 120 to 305 of SEQ ID NO:96 (the identified Pfam "acyltransferase" domain consensus amino acid sequence of human 46745 corresponds to SEQ ID NO:98).

In a preferred embodiment a 46745 polypeptide or protein has an "acyltransferase domain" or a region which includes at least about 100-250 more preferably about 130-200 or 160-200 amino acid residues and has at least about 70% 80% 90% 95%, 99%, or 100% homology with an "acyltransferase domain," e.g., the acyltransferase domain of human 46745 (e.g., amino acid residues 120-305 of SEQ ID NO:96).

To identify the presence of an "acyltransferase" domain in a 46745 protein sequence, and make the determination that a polypeptide or protein of interest has a particular profile, the amino acid sequence of the protein can be searched against a database of HMMs (e.g., the Pfam database, release 2.1) using the default parameters. For example, the hmmsf program, which is available as part of the HMMER package of search programs, is a family specific default program for MILPAT0063 and a score of 15 is the default threshold score for determining a hit. Alternatively, the threshold score for determining a hit can be lowered (e.g., to 8 bits). A description of the Pfam database can be found in Sonhammer et al. (1997) *Proteins* 28(3):405-420 and a detailed description of HMMs can be found, for example, in Gribskov et al. (1990) *Meth. Enzymol.* 183:146-159; Gribskov et al. (1987) *Proc. Natl. Acad. Sci. USA* 84:4355-4358; Krogh et al. (1994) *J. Mol. Biol.* 235:1501-1531; and Stultz et al. (1993) *Protein Sci.* 2:305-314, the contents of which are incorporated herein by reference.

A 46745 family member can include an acyltransferase domain. In one embodiment, a 46745 protein includes at least one transmembrane domain.

As used herein, the term "transmembrane domain" includes an amino acid sequence of about 15 amino acid residues in length that spans a phospholipid membrane. More preferably, a transmembrane domain includes about at least 18, 20, 22, 24, 25, 30, 35 or 40 amino acid residues and spans a phospholipid membrane. Transmembrane domains are rich in hydrophobic residues, and typically have an α-helical structure. In a preferred embodiment, at least 50%, 60%, 70%, 80%, 90%, 95% or more of the amino acids of a transmembrane domain are hydrophobic, e.g., leucines, isoleucines, tyrosines, or tryptophans. Transmembrane domains are described in, for example, Zagotta W. N. et al, (1996) *Annual Rev. Neuronsci.* 19: 235-63, the contents of which are incorporated herein by reference.

In a preferred embodiment, a 46745 polypeptide or protein has at least one transmembrane domain or a region which includes at least 18, 20, 22, 24, 25, 30, 35 or 40 amino acid residues and has at least about 60%, 70% 80% 90% 95%, 99%, or 100% homology with a "transmembrane domain," e.g., at least one transmembrane domain of human 46745 (e.g., amino acid residues 46-69 of SEQ ID NO:96).

In another embodiment, a 46745 protein includes at least one "non-transmembrane domain." As used herein, "non-transmembrane domains" are domains that reside outside of the membrane. When referring to plasma membranes, non-transmembrane domains include extracellular domains (i.e., outside of the cell) and intracellular domains (i.e., within the cell). When referring to membrane-bound proteins found in intracellular organelles (e.g., mitochondria, endoplasmic reticulum, peroxisomes and microsomes), non-transmembrane domains include those domains of the protein that reside in the cytosol (i.e., the cytoplasm), the lumen of the organelle, or the matrix or the intermembrane space (the latter two relate specifically to mitochondria organelles). The C-terminal amino acid residue of a non-transmembrane domain is adjacent to an N-terminal amino acid residue of a transmembrane domain in a naturally-occurring 46745, or 46745-like protein.

In a preferred embodiment, a 46745 polypeptide or protein has a "non-transmembrane domain" or a region which includes at least about 1-500, preferably about 20-490, more preferably about 30-480, and even more preferably about 40-470 amino acid residues, and has at least about 60%, 70% 80% 90% 95%, 99% or 100% homology with a "non-transmembrane domain", e.g., a non-transmembrane domain of human 46745 (e.g., residues 1-45 and 70-535 of SEQ ID NO:96). Preferably, a non-transmembrane domain is capable of catalytic activity (e.g., catalyzing an acylation reaction).

A non-transmembrane domain located at the N-terminus of a 46745 protein or polypeptide is referred to herein as an "N-terminal non-transmembrane domain." As used herein, an "N-terminal non-transmembrane domain" includes an amino acid sequence having about 1-100, preferably about 20-80, more preferably about 30-60, or even more preferably about 40-50 amino acid residues in length and is located outside the boundaries of a membrane. For example, an N-terminal non-transmembrane domain is located at about amino acid residues 1-45 of SEQ ID NO:96.

Similarly, a non-transmembrane domain located at the C-terminus of a 46745 protein or polypeptide is referred to herein as a "C-terminal non-transmembrane domain." As used herein, an "C-terminal non-transmembrane domain" includes an amino acid sequence having about 1-600, preferably about 200-550, preferably about 300-500, more preferably about 400-480 amino acid residues in length and is located outside the boundaries of a membrane. For example, an C-terminal non-transmembrane domain is located at about amino acid residues 70-535 of SEQ ID NO:96.

As the 46745 polypeptides of the invention may modulate 46745-mediated activities, they may be useful as of for developing novel diagnostic and therapeutic agents for 46745-mediated or related disorders, as described below.

As used herein, a "46745 activity", "biological activity of 46745" or "functional activity of 46745", refers to an activity exerted by a 46745 protein, polypeptide or nucleic acid molecule on e.g., a 46745-responsive cell or on a 46745 substrate, e.g., a lipid or protein substrate, as determined in vivo or in vitro. In one embodiment, a 46745 activity is a direct activity, such as an association with a 46745 target molecule. A "target molecule" or "binding partner" is a molecule with which a 46745 protein binds or interacts in nature, e.g., a lipid to which the 46745 protein attaches an acyl chain. A 46745 activity can also be an indirect activity, e.g., a cellular signaling activity mediated by interaction of the 46745 protein with a 46745 ligand. For example, the 46745 proteins of the present invention can have one or more of the following activities: 1) catalyzation of the transfer of an acyl chain to a lipid precursor; 2) regulation of lipid biosynthesis; 3) regulation of wound healing; 4) regulation of platelet aggregation; 5) modulation of mitogenesis; 6) modulation of cellular differentiation; 7) modulation of actin cytoskleleton remodeling; 8) regulation of monocyte chemotaxis; 9) modulation of neurite retraction; 10) modulation of vasoconstriction; 11) modulation of glutamate and glucose uptake by astrocytes; 12) modulation of tumor cell growth and invasion; 13) formation of synaptic-like microvesicles; 14) modulation of cellular proliferation; and 15) the ability to antagonize or inhibit, competitively or non-competitively, any of 1-14.

Based on the above-described sequence similarities, the 46745 molecules of the present invention are predicted to have similar biological activities as acyltransferase family members. Moreover, TaqMan analyses demonstrated that 46745 mRNA is highly expressed in cells derived from lung, breast, and colon tumors. Accordingly, the 46745 molecules can act as novel diagnostic targets and therapeutic agents for controlling one or more of cellular proliferative and/or differentiative disorders, e.g. proliferative disorders of the colon, lung, or breast. Examples of cellular proliferative and/or differentiative disorders include cancer, e.g., carcinoma, sarcoma, and metastatic disorders. A metastatic tumor can arise from a multitude of primary tumor types, including but not limited to those of colon, lung, and breast origin.

Examples of cellular proliferative and/or differentiative disorders of the lung include, but are not limited to, tumors such as bronchogenic carcinoma, including paraneoplastic syndromes, bronchioloalveolar carcinoma, neuroendocrine tumors, such as bronchial carcinoid, miscellaneous tumors, metastatic tumors, and pleural tumors, including solitary fibrous tumors (pleural fibroma) and malignant mesothelioma.

Examples of cellular proliferative and/or differentiative disorders of the breast include, but are not limited to, proliferative breast disease including, e.g., epithelial hyperplasia, sclerosing adenosis, and small duct papillomas; tumors, e.g., stromal tumors such as fibroadenoma, phyllodes tumor, and sarcomas, and epithelial tumors such as large duct papilloma; carcinoma of the breast including in situ (noninvasive) carcinoma that includes ductal carcinoma in situ (including Paget's disease) and lobular carcinoma in situ, and invasive (infiltrating) carcinoma including, but not limited to, invasive ductal carcinoma, invasive lobular carcinoma, medullary carcinoma, colloid (mucinous) carcinoma, tubular carcinoma, and invasive papillary carcinoma, and miscellaneous malignant neoplasms. Disorders in the male breast include, but are not limited to, gynecomastia and carcinoma.

Examples of cellular proliferative and/or differentiative disorders involving the colon include, but are not limited to, tumors of the colon, such as non-neoplastic polyps, adenomas, familial syndromes, colorectal carcinogenesis, colorectal carcinoma, and carcinoid tumors.

The polypeptides and nucleic acids of the invention can also be used to treat, prevent, and/or diagnose cancers and neoplastic conditions in addition to the ones described above. As used herein, the terms "cancer", "hyperproliferative" and "neoplastic" refer to cells having the capacity for autonomous growth, i.e., an abnormal state or condition characterized by rapidly proliferating cell growth. Hyperproliferative and neoplastic disease states may be categorized as pathologic, i.e., characterizing or constituting a disease state, or may be categorized as non-pathologic, i.e., a deviation from normal but not associated with a disease state. The term is meant to include all types of cancerous growths or oncogenic processes, metastatic tissues or malignantly transformed cells, tissues, or organs, irrespective of histopathologic type or stage of invasiveness. "Pathologic hyperproliferative" cells occur in disease states characterized by malignant tumor growth. Examples of non-pathologic hyperproliferative cells include proliferation of cells associated with wound repair.

As the 46745 mRNA is expressed in the normal lung, brain, heart, pancreas, prostate epithelial cells, and aorta, it is likely that 46745 molecules of the present invention are involved in disorders characterized by aberrant activity of these cells. Thus, the 46745 molecules can act as novel diagnostic targets and therapeutic agents for controlling disorders involving aberrant activity of these cells.

The presence of 46745 RNA or protein can also be used to identify a cell or tissue, or other biological sample, as being derived from lung, brain, heart, pancreas, or epithelial cells, e.g. prostate epithelial cells, or being of human origin. Expression can also be used to diagnose or stage a disorder, e.g., a cancer, a colon, lung, or breast disorder, e.g., cancer of the colon, lung, or breast. Expression can be determined by evaluating RNA, e.g., by hybridization of a 46745 specific probe, or with a 46745 specific antibody.

Identification and Characterization of Human 46745 cDNA

The human 46745 sequence (SEQ ID NO:95), which is approximately 2090 nucleotides long including untranslated regions, contains a predicted methionine-initiated coding sequence of about 1605 nucleotides (nucleotides 129-1733 of SEQ ID NO:95; SEQ ID NO:97). The coding sequence encodes a 534 amino acid protein (SEQ ID NO:96).

Tissue Distribution of 46745 mRNA

Endogenous human 46745 gene expression was determined using the Perkin-Elmer/ABI 7700 Sequence Detection System which employs TaqMan® technology. Briefly, TaqMan® technology relies on standard RT-PCR with the addition of a third gene-specific oligonucleotide (referred to as a probe) which has a fluorescent dye coupled to its 5' end (typically 6-FAM) and a quenching dye at the 3' end (typically TAMRA). When the fluorescently tagged oligonucleotide is intact, the fluorescent signal from the 5' dye is quenched. As PCR proceeds, the 5' to 3' nucleolytic activity of taq polymerase digests the labeled primer, producing a free nucleotide labeled with 6-FAM, which is now detected as a fluorescent signal. The PCR cycle where fluorescence is first released and detected is directly proportional to the starting amount of the gene of interest in the test sample, thus providing a way of quantitating the initial template concentration. Samples can be internally controlled by the addition of a second set of primers/probe specific for a housekeeping gene such as GAPDH which has been labeled with a different fluorophore on the 5' end (typically VIC).

To determine the level of 46745 in various human tissues a primer/probe set was designed using Primer Express (Perkin-Elmer) software and primary cDNA sequence information. Total RNA was prepared from a series of human tissues using an RNeasy kit from Qiagen. First strand cDNA was prepared from one ug total RNA using an oligo dT primer and Superscript II reverse transcriptase (Gibco/BRL). cDNA obtained from approximately 50 ng total RNA was used per TaqMan® reaction.

Normal tissues tested by TaqMan® analysis included fetal heart, brain, ovary, colon, lung, and aorta, among others. Elevated expression was found primarily in brain, lung, fetal heart, and aorta.

Additional TaqMan® analyses compared expression of 46745 in normal and tumor cells derived from several tissues. Increased expression of 46745 was seen in colon tumors when compared to normal colon tissues. Increased expression of 46745 was also seen in lung tumors when compared to normal lung tissue. Increased expression of 46745 was seen in breast tumors when compared to normal breast tissue.

The incidence of tumor associated expression of 46745 in tumors of the colon, breast, and lung was evaluated by in situ hybridization. High expression of 46745 was detected in lung tumor cells (expression in 0/2 normal samples and expression in 5/5 tumor samples). Moderate to low expression of 46745 was detected in breast tumor cell epithelium (expression in 0/2 normal samples and expression in 4/6 tumor samples). Low to no expression of 46745 was detected in tumor cells of primary tumors and liver metastases (expression in 0/3 normal samples; expression in 1/3 tumor samples; and expression in 1/3 metastases samples).

Human 23155

The present invention is based, at least in part, on the discovery of novel molecules, referred to herein as "23155" nucleic acid and polypeptide molecules, which play a role in or function in signalling pathways associated with cellular growth. In one embodiment, the 23155 molecules modulate the activity of one or more proteins involved in cellular growth or differentiation, e.g., cardiac cell growth or differentiation. In another embodiment, the 23155 molecules of the present invention are capable of modulating the phosphorylation state of a 23155 molecule or one or more proteins involved in cellular growth or differentiation.

The present invention is based, at least in part, on the discovery of novel molecules, referred to herein as 23155 protein and nucleic acid molecules, which comprise a family of molecules having certain conserved structural and functional features. The term "family" when referring to the protein and nucleic acid molecules of the invention is intended to mean two or more proteins or nucleic acid molecules having a common structural domain or motif and having sufficient amino acid or nucleotide sequence homology as defined herein. Such family members can be naturally or non-naturally occurring and can be from either the same or different species. For example, a family can contain a first protein of human origin, as well as other, distinct proteins of human origin or alternatively, can contain homologues of non-human origin. Members of a family may also have common functional characteristics.

One embodiment of the invention features 23155 nucleic acid molecules, preferably human 23155 molecules, e.g., 23155. The 23155 nucleic acid and protein molecules of the invention are described in further detail in the following subsections.

The 23155 Nucleic Acid and Protein Molecules

The human 23155 sequence (SEQ ID NO:107), which is approximately 1287 nucleotides long including untranslated regions, contains a predicted methionine-initiated coding sequence of about 957 nucleotides, including the termination codon (nucleotides indicated as coding sequence of SEQ ID NO:107; SEQ ID NO:109). The 23155 gene, which is approximately 1287 nucleotides in length, encodes a protein having a molecular weight of approximately 35.1 kD and which is approximately 318 amino acid residues in length (SEQ ID NO:108). The human 23155 protein of SEQ ID NO:108 includes an amino-terminal hydrophobic amino acid sequence, consistent with a signal sequence, of about 41 amino acids (from amino acid 1 to about amino acid 41 of SEQ ID NO:108, (PSORT, Nakai, K. and Kanehisa, M. (1992) *Genomics* 14:897-911)), which upon cleavage results in the production of a mature protein form.

Human 23155 contains the following regions or other structural features (for general information regarding PFAM identifiers, PS prefix and PF prefix domain identification numbers, refer to Sonnhammer et al. (1997) Protein 28:405-420: a 3-oxo-5-alpha-steroid 4-dehydrogenase domain (PFAM Accession Number PF02544) located at about amino acid residues 145 to 318 of SEQ ID NO:108; seven transmembrane domains (predicted by MEMSAT, Jones et al. (1994) Biochemistry 33:3038-3049) at about amino acids 22 to 46, 75 to 91, 98 to 118, 125 to 141, 156 to 178, 199 to 215 and 260 to 281 of SEQ ID NO:108; one N-glycosylation site (Prosite PS00001) from about amino acids 274 to 277 of SEQ ID NO:108; one protein kinase C phosphorylation sites (Prosite PS00005) at about amino acids 140 to 142, and 191 to 193 of SEQ ID NO:108; one tyrosine kinase phosphorylation site (Prosite PS00007) located at about amino acids 142 to 149 of SEQ ID NO:108; and two N-myristoylation sites (Prosite PS00008) from about amino acids 38 to 43, and 122 to 127 of SEQ ID NO:108.

23155 polypeptides of the invention include fragments which include: all or part of a hydrophobic sequence, e.g., the sequence from about amino acid 90 to 110, from about 150 to 180, and from about 260 to 270 of SEQ ID NO:108; all or part of a hydrophilic sequence, e.g., the sequence from about amino acid 50 to 70, from about 180 to 190, and from about 295 to 310 of SEQ ID NO:108; a sequence which includes a Cys, or a glycosylation site.

In one embodiment, the isolated proteins of the present invention, preferably 23155 proteins, are identified based on the presence of at least one "5-α reductase" domain. As used herein, the term "5-α reductase domain" includes an amino acid sequence of about 100-400 amino acid residues in length, preferably about 100-300 amino acid residues in length, and more preferably about 100-250 amino acid residues in length, which is conserved in 5-α reductases and having a bit score for the alignment of the sequence to the 5-α reductase domain (HMM) of at least about 10, preferably about 15, and more preferably about 25. Short, conserved, stretches of amino acid residues may be present within the 5-α reductase domain, which alternate in sequence with variable-length stretches of amino acid residues which do not exhibit a high level of conservation.

The 5-α reductase domain is located after about the fourth transmembrane domain of human 23155 polypeptide and which corresponds to about amino acids 145 to 318 of SEQ ID NO:108. The 5-α reductase domain (HMM) has been assigned the PFAM Accession Number PF02544.

In a preferred embodiment, a 23155 polypeptide or protein has a "5-α reductase domain" or a region which includes at least about 100-400 more preferably about 100-300 or 100-250 amino acid residues and has at least about 60%, 70% 80% 90% 95%, 99%, or 100% homology with a "5-α reductase domain," e.g., the 5-α reductase domain of human 23155 (e.g., residues 145 to 318 of SEQ ID NO:108).

To identify the presence of a "5-α reductase" domain in a 23155 protein sequence, and make the determination that a polypeptide or protein of interest has a particular profile, the amino acid sequence of the protein can be searched against the Pfam database of HMMs (e.g., the Pfam database, release 2.1) using the default parameters. For example, the hmmsf program, which is available as part of the HMMER package of search programs, is a family specific default program for MILPAT0063 and a score of 15 is the default threshold score for determining a hit. Alternatively, the threshold score for determining a hit can be lowered (e.g., to 8 bits). A description of the Pfam database can be found in Sonhammer et al. (1997) Proteins 28:405-420 and a detailed description of HMMs can be found, for example, in Gribskov et al. (1990) Meth. Enzymol. 183:146-159; Gribskov et al. (1987) Proc. Natl. Acad. Sci. USA 84:4355-4358; Krogh et al. (1994) J. Mol. Biol. 235:1501-1531; and Stultz et al. (1993) Protein Sci. 2:305-314, the contents of which are incorporated herein by reference. A search was performed against the HMM database resulting in the identification of a "5-α reductase" domain in the amino acid sequence of human 23155 at about residues 145 to 318 of SEQ ID NO:108 (the identified Pfam "5-α reductase" domain consensus amino acid sequences of human 23155 corresponds to SEQ ID NO:110).

The 5-α reductase domain is homologous to ProDom family "steriod 3-oxo-5-alpha-steriod 4-dehydrogenase 5-alpha-reductase SR type oxidoreductase microsome membrane sexual," SEQ ID NO:111 ProDomain Release 1999.2. ProDom (derived from BLAST search) alignments of the amino acid sequence of human 23155 revealed that 23155 is similar to the "steriod 3-oxo-5-alpha-steriod 4-dehydrogenase 5-alpha-reductase SR type oxidoreductase microsome membrane sexual" protein. This amino acid molecule is approximately 34% identical to 23155, over amino acids 201 to 317 (SEQ ID NO:111).

To identify the presence of a "steriod 3-oxo-5-alpha-steriod 4-dehydrogenase 5-alpha-reductase SR type oxidoreductase microsome membrane sexual" domain in a 23155 protein sequence, and make the determination that a polypeptide or protein of interest has a particular profile, the amino acid sequence of the protein can be searched against a database of domains, e.g., the ProDom database (Corpet et al. (1999), Nucl. Acids Res. 27:263-267). The ProDom protein domain database consists of an automatic compilation of homologous domains. Current versions of ProDom are built using recursive PSI-BLAST searches (Altschul S F et al. (1997) Nucleic Acids Res. 25:3389-3402; Gouzy et al. (1999) Computers and Chemistry 23:333-340) of the SWISS-PROT 38 and TREMBL protein databases. The database automatically generates a consensus sequence for each domain. A BLAST search was performed against the HMM database resulting in the identification of a "steriod 3-oxo-5-alpha-steriod 4-dehydrogenase 5-alpha-reductase SR type oxidoreductase microsome membrane sexual" domain in the amino acid sequence of human 23155 at about residues 201 to 317 of SEQ ID NO:108 (the identified ProDom "steriod 3-oxo-5-alpha-steriod 4-dehydrogenase 5-alpha-reductase SR type oxidoreductase microsome membrane sexual" domain consensus amino acid sequences of human 23155 corresponds to SEQ ID NO:111).

The enzyme 5-α reductase (EC 1.3.99.5) is a membrane protein that plays a key role in androgen-dependent target tissues. In such tissues, 5-α reductase in target cells reduces the androgen testosterone to α-dihydrotestosterone (DHT) and thus catalyzes the conversion of testosterone into its activated form, DHT. DHT is a steroid that binds to androgen receptors with higher affinity than testosterone. Thus, 5-α reductase plays an important role relating to androgen levels, which effect the growth and function of many tissues in addition to the reproductive organs.

When 5-α reductase activity is defective, the levels of DHT are reduced and thus, androgen receptors are only partially activated and a full androgen response is not obtained. Those tissues that require high levels of androgens for normal development, such as primordia of external genitalia, do not develop normally and resemble the female phenotype, a clinical condition called male pseudohermaphrodism. (Geoffrey Zubay, Biochemistry 1112-14 (1984)). In contrast, the overproduction of DHT is also associated with human endocrine disorders. Steroidal or non-steroidal inhibitors of 5-α reductase activity have been used to treat human endocrine disorders such as benign prostatic hyperplasia, a disease that occurs almost universally in males which is characterized by obstructive and irritative urinary voiding symptoms. (Proc Natl Acad Sci USA 1993 Jun. 1; 90 (11):5277-81). Regulation of 5-α reductase activity may therefore be an important strategy in controlling some types of human endocrine disorders associated with the inhibition or over stimulation of 5-α reductase activity. Further, testosterone and the steroids metabolized by 5-α reductase influence processes such as cellular proliferation and cell survival, both of which factor into tumor progression.

Isolated proteins of the present invention, preferably 23155 proteins, have an amino acid sequence sufficiently homologous to the amino acid sequence of SEQ ID NO:108 or are encoded by a nucleotide sequence sufficiently homologous to SEQ ID NO:107 or SEQ ID NO:109. As used herein, the term "sufficiently homologous" refers to a first amino acid or nucleotide sequence which contains a sufficient or minimum number of identical or equivalent (e.g., an amino acid residue which has a similar side chain) amino acid residues or nucleotides to a second amino acid or nucleotide sequence such that the first and second amino acid or nucleotide sequences share common structural domains or motifs and/or a common functional activity. For example, amino acid or nucleotide sequences which share common structural domains have at least 30%, 40%, or 50% homology, preferably 60% homology, more preferably 70%-80%, and even more preferably 90-95% homology across the amino acid sequences of the domains and contain at least one and preferably two structural domains or motifs, are defined herein as sufficiently homologous. Furthermore, amino acid or nucleotide sequences which share at least 30%, 40%, or 50%, preferably 60%, more preferably 70-80%, or 90-95% homology and share a common functional activity are defined herein as sufficiently homologous.

A 23155 polypeptide can include at least one, two, three, four, five, six, and preferably seven "transmembrane domains" or regions homologous with "transmembrane domains". As used herein, the term "transmembrane domain" includes an amino acid sequence of about 10 to 40 amino acid residues in length and spans the plasma membrane. Transmembrane domains are rich in hydrophobic residues, e.g., at least 50%, 60%, 70%, 80%, 90%, 95% or more of the amino acids of a transmembrane domain are hydrophobic, e.g., leucines, isoleucines, tyrosines, or tryptophans. Transmembrane domains typically have alpha-helical structures and are described in, for example, Zagotta, W. N. et al., (1996) Annual Rev. Neurosci. 19:235-263, the contents of which are incorporated herein by reference.

In a preferred embodiment, a 23155 polypeptide or protein has at least one, two, three, four, five, six and preferably seven "transmembrane domains" or regions which include at least about 12 to 35 more preferably about 14 to 30 or 15 to 25 amino acid residues and has at least about 60%, 70% 80% 90% 95%, 99%, or 100% homology with a "transmembrane domain," e.g., the transmembrane domains of human 23155

(e.g., residues 22 to 46, 75 to 91, 98 to 118, 125 to 141, 156 to 178, 199 to 215 and 260 to 281 of SEQ ID NO:108).

To identify the presence of a "transmembrane" domain in a 23155 protein sequence, and make the determination that a polypeptide or protein of interest has a particular profile, the amino acid sequence of the protein can be analyzed by a transmembrane prediction method that predicts the secondary structure and topology of integral membrane proteins based on the recognition of topological models (MEMSAT, Jones et al., (1994) *Biochemistry* 33:3038-3049).

A 23155 polypeptide can include at least one, two, three, four, five, six, seven, eight preferably nine "non-transmembrane regions." As used herein, the term "non-transmembrane region" includes an amino acid sequence not identified as a transmembrane domain. The non-transmembrane regions in 23155 are located at about amino acids 1 to 21, 47 to 74, 92 to 97, 119 to 124, 142 to 155, 179 to 198, 216 to 259, and 281 to 318 of SEQ ID NO:108.

The non-transmembrane regions of 23155 include at least one, two or three, preferably four cytoplasmic regions. When located at the C-terminus, the cytoplasmic region is referred to herein as the "C-terminal cytoplasmic domain." As used herein, an "C-terminal cytoplasmic domain" includes an amino acid sequence having about 1 to 50, preferably about 1 to 45, more preferably about 1 to 40, or even more preferably about 1 to 37 amino acid residues in length and is located inside of a cell or within the cytoplasm of a cell. The C-terminal amino acid residue of an "C-terminal cytoplasmic domain" is adjacent to an C-terminal amino acid residue of a transmembrane domain in a 23155 protein. For example, an C-terminal cytoplasmic domain is located at about amino acid residues 282 to 318 of SEQ ID NO:108.

In a preferred embodiment, a polypeptide or protein has an C-terminal cytoplasmic domain or a region which includes at least about 5, preferably about 1 to 30, and more preferably about 1 to 37 amino acid residues and has at least about 60%, 70% 80% 90% 95%, 99%, or 100% homology with an "C-terminal cytoplasmic domain," e.g., the C-terminal cytoplasmic domain of human 23155 (e.g., residues 282 to 318 of SEQ ID NO:108).

In another embodiment, a 23155 protein includes at least one, two and preferably three cytoplasmic loops. As used herein, the term "loop" includes an amino acid sequence that resides outside of a phospholipid membrane, having a length of at least about 5, preferably about 5 to 50, more preferably about 7 to 28 amino acid residues, and has an amino acid sequence that connects two transmembrane domains within a protein or polypeptide. Accordingly, the N-terminal amino acid of a loop is adjacent to a C-terminal amino acid of a transmembrane domain in a 23155 molecule, and the C-terminal amino acid of a loop is adjacent to an N-terminal amino acid of a transmembrane domain in a 23155 molecule. As used herein, a "cytoplasmic loop" includes a loop located inside of a cell or within the cytoplasm of a cell. For example, a "cytoplasmic loop" can be found at about amino acid residues 47 to 74, 119 to 124, or 179 to 198 of SEQ ID NO:108.

In a preferred embodiment, a 23155 polypeptide or protein has a cytoplasmic loop or a region which includes at least about 5, preferably about 5 to 50, more preferably about 7 to 28 amino acid residues and has at least about 60%, 70% 80% 90% 95%, 99%, or 100% homology with a cytoplasmic loop," e.g., a cytoplasmic loop of human 23155 (e.g., residues 47 to 74, 119 to 124, or 179 to 198 of SEQ ID NO:108).

In another embodiment, a 23155 protein includes at least one, preferably two non-cytoplasmic loops. As used herein, a "non-cytoplasmic loop" includes an amino acid sequence located outside of a cell or within an intracellular organelle. Non-cytoplasmic loops include extracellular domains (i.e., outside of the cell) and intracellular domains (i.e., within the cell). When referring to membrane-bound proteins found in intracellular organelles (e.g., mitochondria, endoplasmic reticulum, peroxisomes microsomes, vesicles, endosomes, and lysosomes), non-cytoplasmic loops include those domains of the protein that reside in the lumen of the organelle or the matrix or the intermembrane space. For example, a "non-cytoplasmic loop" can be found at about amino acid residues 92 to 97, 142 to 155, and 216 to 259, of SEQ ID NO:108.

In a preferred embodiment, a 23155 polypeptide or protein has at least one non-cytoplasmic loop or a region which includes at least about 5, preferably about 5 to 50, more preferably about 6 to 44 amino acid residues and has at least about 60%, 70% 80% 90% 95%, 99%, or 100% homology with a "non-cytoplasmic loop," e.g., at least one non-cytoplasmic loop of human 23155 (e.g., residues 92 to 97, 142 to 155, and 216 to 259 of SEQ ID NO:108).

A 23155 family member can include at least one 3-oxo-5-alpha-steroid 4-dehydrogenase domain or a 5-α reductase domain or at least one, two, three, four, five, six, seven, eight and preferably nine transmembrane or non-transmembrane domains. Furthermore, a 23155 family member can include at least one N-glycosylation site (PS00001); at least one, preferably two protein kinase C phosphorylation sites (PS00005); at least one tyrosine kinase phosphorylation site (PS00007); or at least one and preferably two N-myristoylation sites (PS00008).

As used interchangeably herein a "23155 activity", "biological activity of 23155" or "functional activity of 23155", refers to an activity exerted by a 23155 protein, polypeptide or nucleic acid molecule on a 23155 responsive cell or a 23155 protein substrate, as determined in vivo, or in vitro, according to standard techniques. The biological activity of 23155 is described herein.

Accordingly, another embodiment of the invention features isolated 23155 proteins and polypeptides having a 23155 activity. Preferred proteins are 23155 proteins having at least one 5-α reductase activity, preferably, a 23155 activity. Additional preferred proteins have at least one 5-α reductase domain and are, preferably, encoded by a nucleic acid molecule having a nucleotide sequence which hybridizes under stringent hybridization conditions to a nucleic acid molecule comprising the nucleotide sequence of SEQ ID NO:107 or SEQ ID NO:109.

A 23155 activity can also be an indirect activity, e.g., a cellular signaling activity mediated by interaction of the 23155 protein with a 23155 receptor. Based on the above-described sequence structures and similarities to molecules of known function, the 23155 molecules of the present invention have similar biological activities as 5-α reductase family members. For example, the 23155 proteins of the present invention can have one or more of the following activities: (1) regulating a variety of cellular processes affected by androgens, e.g., including the differentiation, growth and maintenance of many tissues in addition to reproductive organs; (2) modulating endocrine functions characterized by abnormal androgen processing; (3) steroid metabolism e.g. converting testosterone into its activated form (dihydrotestosterone); (4) modulating cellular proliferation and cell survival; and (5) the ability to antagonize or inhibit, competitively or non-competitively, any or all of (1)-(5).

Thus, the 23155 molecules can act as novel diagnostic targets and therapeutic agents for controlling one or more cancers or disorders relating to cellular proliferation and cell survival. Examples of such disorders, e.g., 5-α reductase-associated or other 23155-associated disorders, include but are not limited to, cellular proliferative and/or differentiative disorders, disorders associated with bone metabolism, immune e.g., inflammatory disorders, cardiovascular disorders, including endothelial cell disorders, liver disorders, viral diseases, pain or metabolic disorders, and preferably cellular proliferative and/or differentiative disorders.

The 23155 gene is expressed predominantly in the brain and protate epithelium as well as lung tumors, colon tumors, and ovarian tumors.

Expression and Tissue Distribution of 23155 mRNA

Northern blot hybridizations with various RNA samples can be performed under standard conditions and washed under stringent conditions, i.e., 0.2×SSC at 65° C. A DNA probe corresponding to all or a portion of the 23155 cDNA (SEQ ID NO:107) can be used. The DNA is radioactively labeled with $^{32}$P-dCTP using the Prime-It Kit (Stratagene, La Jolla, Calif.) according to the instructions of the supplier. Filters containing mRNA from mouse hematopoietic and endocrine tissues, and cancer cell lines (Clontech, Palo Alto, Calif.) can be probed in ExpressHyb hybridization solution (Clontech) and washed at high stringency according to manufacturer's recommendations. TaqMan® real-time quantitative RT-PCR is used to detect the presence of RNA transcript corresponding to human 23155 in several tissues. It is found that the corresponding orthologs of 23155 are expressed in a variety of tissues.

Reverse Transcriptase PCR(RT-PCR) was used to detect the presence of RNA transcript corresponding to human 23155 in RNA prepared from tumor and normal tissues. If a subject has a disease characterized by underexpression or overexpression of a 23155 gene, modulators which have a stimulatory or inhibitory effect on protein 5-α reductase activity (e.g., protein 5-α reductase gene expression) can be administered to individuals to treat (prophylactically or therapeutically) protein 5-α reductase-associated disorders.

TaqMan® analyses have demonstrated the ubiquitous relative expression levels of 23155 in various human tissues or cells, including but not limited to, normal artery, diseased aorta, normal vein, coronary smooth muscle cells (SMC) human umbilical vein endothelial cells (HUVEC), hemangioma, normal heart, coronary heart failure heart tissue, kidney, normal adipose, pancreas, primary osteoblasts, osteoclasts, skin, spinal cord, brain cortex, brain hypothalamus, nerve, dorsal root ganglia (DRS), normal breast, breast tumor, normal ovary, ovary tumor, normal prostate and prostate tumor, salivary glands, normal colon and colon tumor, normal lung and lung tumor, lung COPD, colon IBD, normal liver and liver fibrosis, spleen, tonsil, lymph node, small intestine, macrophages, synovium, BM-MNC, activated PBMC, neutrophlis, megakaryocytes, and erythroid, among others, detected using real-time quantitative RT-PCR Taq Man analysis. The results show significant expression in HUVEC, normal human brain cortex, hypothalamus, normal fetal liver, epithelial cells, colon tumor and lung tumor tissues.

Additional TaqMan® analyses showed variable expression in lung tumor cell lines and tissues for 23155. The highest expression for 23155 was found in the lung tumor cell line, NCIH 67.

In an expanded oncology TaqMan® panel, 23155 expression was observed in colon and normal tumor with increased expression in 4/8 colon tumor samples in comparison to normal colon tissue samples and increased expression in 2/4 liver metastasis in comparison to normal liver tissues. In an angiogenic panel, variable expression was found in all tissues.

In another expanded TaqMan® oncology panel, 23155 showed variable expression in breast tumor and normal breast tissue samples. Decreased 23155 expression was found in 2/6 ovary tumor samples in comparison to normal ovary samples as demonstrated in an expanded ovarian TaqMan® panel. Additionally, 23155 expression was shown to be increased in 7/7 lung tumor samples in comparison to normal lung tissue samples.

Expression profiling results using in situ hybridization techniques have shown that 23155 mRNA has been detected in human lung, colon, ovary and breast tissues. Positive expression of 23155 has been shown in 6/8 lung tumors and lung inflammatory cells in comparison with lack of expression, 0/2, in normal lung tissue samples. In addition, positive expression of 23155 has been shown in 2/2 colon tumors and some metastases (2/4) in comparison with low expression, 1/2, in normal colon tissue samples. Further, 23155 has been shown to be expressed both in tumors and normal tissues, of normal ovarian stroma (1/2) and tumors (2/4). Regarding breast tissue, negative expression of 23155 was found in both normal (0/1) and tumor (0/2).

As seen by these results, 23155 molecules have been found to be overexpressed in some tumors or cells, where the molecules may be inappropriately propagating either cell proliferation or cell survival signals or have aberrant protein 5-α reductase activity. As such, 23155 molecules may serve as specific and novel identifiers of such tumor cells or disorders.

Further, modulators of the 23155 molecules are useful for the treatment of cancer. For example, inhibitors of the 23155 molecules are useful for the treatment of cancer where 23155 is upregulated in tumor cells such as lung, colon, breast, and ovarian cancer and in particular lung cancer, and are useful as a diagnostic.

Human 21657

The present invention is based, at least in part, on the discovery of novel molecules, referred to herein as "21657", "short-chain dehydrogenase" or "SCDR" nucleic acid and protein molecules, which are novel members of a family of enzymes possessing short-chain dehydrogenase activity. These novel molecules are capable of oxidizing or reducing biological molecules by catalyzing the transfer of a hydride moiety and, thus, play a role in or function in a variety of cellular processes, e.g., cellular proliferation, growth, differentiation, migration, hormonal responses, and inter- or intracellular communication.

The oxidation and reduction of molecules is of critical importance in most metabolic and catabolic pathways in cells. A large family of enzymes that facilitates these molecular alterations, termed the dehydrogenase family, has been identified. In the forward reaction, these enzymes catalyze the transfer of a hydride ion from the target substrate to the enzyme or a cofactor of the enzyme (e.g., NAD$^+$ or NADP$^+$), thereby forming a carbonyl group on the substrate. These enzymes are also able to participate in the reverse reaction, wherein a carbonyl group on the target molecule is reduced by the transfer of a hydride group from the enzyme.

Different classes of dehydrogenases are specific for an array of biological and chemical substrates. For example, there exist dehydrogenases specific for alcohols, for aldehydes, for steroids, and for lipids. The short-chain dehydrogenases, part of the alcohol oxidoreductase superfamily (Reid et al. (1994) *Crit. Rev. Microbiol.* 20: 13-56), are Zn$^{++}$-independent enzymes with an N-terminal cofactor (typically NAD$^+$ or NADP$^+$) binding site and a C-terminal catalytic domain (Persson et al. (1995) *Adv. Exp. Med. Biol.* 372: 383-395; Jornvall et al., supra). The steroid dehydrogenases are a subclass of the short-chain dehydrogenases, and are known to be involved in a variety of biochemical pathways, affecting mammalian reproduction, hypertension, neoplasia, and digestion (Duax et al. (2000) *Vitamins and Hormones* 58: 121-148). Within the family of short-chain dehydrogenases, each enzyme is specific for a particular substrate (e.g., a steroid or an alcohol, but not both with equivalent affinity). This exquisite specificity permits tight regulation of the metabolic and catabolic pathways in which these enzymes participate, without affecting similar but separate biochemical pathways in the same cell or tissue.

Members of the short-chain dehydrogenase family are found in nearly all organisms, from microbes to *Drosophila* to humans. Both between species and within the same species, short-chain dehydrogenases vary widely (members typically display only 15-30% amino acid sequence identity) (Jornvall et al. (1995) *Biochemistry* 34: 6003-6013). Structural similarities between family members are most frequently found in the cofactor binding site and the catalytic site of the enzyme, which have the conserved sequence motifs GxxxGxG and YxxxK, respectively (Jornvall et al., supra; and Persson et al. (1991) *Eur. J. Biochem.* 200(2), 537-543). Short-chain dehydrogenases play important roles in the production and breakdown of a number of major metabolic intermediates, including amino acids, vitamins, energy molecules (e.g., glucose, sucrose, and their breakdown products), signal molecules (e.g., hormones, transcription factors, and neurotransmitters), and nucleic acids. These enzymes also catalyze the breakdown of potentially harmful compounds, such as alcohols. As such, their activity contributes to the ability of the cell to grow and differentiate, to proliferate, to communicate and interact with other cells, and to render harmless substances which are potentially toxic to the cell. Underscoring the importance of this family of enzymes, deficiencies in one or more short-chain dehydrogenases have been linked to a number of human diseases (e.g., a deficiency in short-chain acyl-CoA dehydrogenase has been shown to underlie acute acidosis, muscle weakness, developmental delay, and seizures in human infants, and chronic myopathy in middle-aged patients).

As used herein, the term "short-chain dehydrogenase" includes a molecule which is involved in the oxidation or reduction of a biochemical molecule (e.g., an alcohol, a vitamin, or a steroid), by catalyzing the transfer of a hydride ion to or from the biochemical molecule. Short-chain dehydrogenase molecules are involved in the metabolism and catabolism of biochemical molecules necessary for energy production or storage, for intra- or intercellular signaling, for metabolism or catabolism of metabolically important biomolecules, and for detoxification of potentially harmful compounds. The short-chain dehydrogenase family also includes mammalian enzymes which control hormone actions such as fertility, growth and hypertension, as well as neoplastic processes. Examples of short-chain dehydrogenases include alcohol dehydrogenases and steroid dehydrogenases. Thus, the SCDR molecules of the present invention provide novel diagnostic targets and therapeutic agents to control short-chain dehydrogenase-associated disorders.

As used herein, a "short-chain dehydrogenase-associated disorder" includes a disorder, disease or condition which is caused or characterized by a misregulation (e.g., downregulation or upregulation) of short-chain dehydrogenase activity. Short-chain dehydrogenase-associated disorders can detrimentally affect cellular functions such as cellular proliferation, growth, differentiation, or migration, inter- or intracellular communication; tissue function, such as cardiac function or musculoskeletal function; systemic responses in an organism, such as nervous system responses, or hormonal responses (e.g., insulin response); and protection of cells from toxic compounds (e.g., carcinogens, toxins, or mutagens). Examples of short-chain dehydrogenase-associated disorders include CNS disorders such as cognitive and neurodegenerative disorders, examples of which include, but are not limited to, Alzheimer's disease, dementias related to Alzheimer's disease (such as Pick's disease), Parkinson's and other Lewy diffuse body diseases, senile dementia, Huntington's disease, Gilles de la Tourette's syndrome, multiple sclerosis, amyotrophic lateral sclerosis, progressive supranuclear palsy, epilepsy, and Jakob-Creutzfieldt disease; autonomic function disorders such as hypertension and sleep disorders, and neuropsychiatric disorders, such as depression, schizophrenia, schizoaffective disorder, korsakoff's psychosis, mania, anxiety disorders, or phobic disorders; learning or memory disorders, e.g., amnesia or age-related memory loss, attention deficit disorder, dysthymic disorder, major depressive disorder, mania, obsessive-compulsive disorder, psychoactive substance use disorders, anxiety, phobias, panic disorder, as well as bipolar affective disorder, e.g., severe bipolar affective (mood) disorder (BP-1), and bipolar affective neurological disorders, e.g., migraine and obesity. Further CNS-related disorders include, for example, those listed in the American Psychiatric Association's Diagnostic and Statistical manual of Mental Disorders (DSM), the most current version of which is incorporated herein by reference in its entirety.

Further examples of short-chain dehydrogenase-associated disorders include cardiac-related disorders. Cardiovascular system disorders in which the SCDR molecules of the invention may be directly or indirectly involved include arteriosclerosis, ischemia reperfusion injury, restenosis, arterial inflammation, vascular wall remodeling, ventricular remodeling, rapid ventricular pacing, coronary microembolism, tachycardia, bradycardia, pressure overload, aortic bending, coronary artery ligation, vascular heart disease, atrial fibrillation, Jervell syndrome, Lange-Nielsen syndrome, long-QT syndrome, congestive heart failure, sinus node dysfunction, angina, heart failure, hypertension, atrial fibrillation, atrial flutter, dilated cardiomyopathy, idiopathic cardiomyopathy, myocardial infarction, coronary artery disease, coronary artery spasm, and arrhythmia. SCDR-mediated or related disorders also include disorders of the musculoskeletal system such as paralysis and muscle weakness, e.g., ataxia, myotonia, and myokymia.

Short-chain dehydrogenase disorders also include cellular proliferation, growth, differentiation, or migration disorders. Cellular proliferation, growth, differentiation, or migration disorders include those disorders that affect cell proliferation, growth, differentiation, or migration processes. As used herein, a "cellular proliferation, growth, differentiation, or migration process" is a process by which a cell increases in number, size or content, by which a cell develops a specialized set of characteristics which differ from that of other cells, or by which a cell moves closer to or further from a particular location or stimulus. The SCDR molecules of the present invention are involved in signal transduction mechanisms, which are known to be involved in cellular growth, differentiation, and migration processes. Thus, the SCDR molecules may modulate cellular growth, differentiation, or migration, and may play a role in disorders characterized by aberrantly regulated growth, differentiation, or migration. Such disorders include cancer, e.g., carcinoma, sarcoma, or leukemia; tumor angiogenesis and metastasis; skeletal dysplasia; hepatic disorders; and hematopoietic and/or myeloproliferative disorders.

SCDR-associated or related disorders also include hormonal disorders, such as conditions or diseases in which the production and/or regulation of hormones in an organism is aberrant. Examples of such disorders and diseases include type I and type II diabetes mellitus, pituitary disorders (e.g., growth disorders), thyroid disorders (e.g., hypothyroidism or hyperthyroidism), and reproductive or fertility disorders (e.g., disorders which affect the organs of the reproductive system, e.g., the prostate gland, the uterus, or the vagina; disorders which involve an imbalance in the levels of a reproductive hormone in a subject; disorders affecting the ability of a subject to reproduce; and disorders affecting secondary sex characteristic development, e.g., adrenal hyperplasia).

SCDR-associated or related disorders also include disorders affecting tissues in which SCDR protein is expressed.

The present invention also provides methods and compositions for the diagnosis and treatment of tumorigenic disease, e.g., lung tumors, ovarian tumors, colon tumors, breast tumors, Wilm's tumors, lymphoangionas, and neuroblastomas. The present invention is based, at least in part, on the discovery that SCDR is differentially expressed in tumor tissue samples relative to its expression in normal tissue samples.

"Differential expression", as used herein, includes both quantitative as well as qualitative differences in the temporal and/or tissue expression pattern of a gene. Thus, a differentially expressed gene may have its expression activated or inactivated in normal versus tumorigenic disease conditions (for example, in an experimental tumorigenic disease system). The degree to which expression differs in normal versus tumorigenic disease or control versus experimental states need only be large enough to be visualized via standard characterization techniques, e.g., quantitative PCR, Northern analysis, or subtractive hybridization. The expression pattern of a differentially expressed gene may be used as part of a prognostic or diagnostic tumorigenic disease evaluation, or may be used in methods for identifying compounds useful for the treatment of tumorigenic disease. In addition, a differentially expressed gene involved in a tumorigenic disease may represent a target gene such that modulation of the level of target gene expression or of target gene product activity may act to ameliorate a tumorigenic disease condition. Compounds that modulate target gene expression or activity of the target gene product can be used in the treatment of tumorigenic disease. Although the SCDR genes described herein may be differentially expressed with respect to tumorigenic disease, and/or their products may interact with gene products important to tumorigenic disease, the genes may also be involved in mechanisms important to additional cell processes.

As used herein, a "short-chain dehydrogenase-mediated activity" includes an activity which involves the oxidation or reduction of one or more biochemical molecules, e.g., biochemical molecules in a neuronal cell, a muscle cell, or a liver cell associated with the regulation of one or more cellular processes. Dehydrogenase-mediated activities include the oxidation or reduction of biochemical molecules necessary for energy production or storage, for intra- or intercellular signaling, for metabolism or catabolism of metabolically important biomolecules, and for detoxification of potentially harmful compounds.

The term "family" when referring to the protein and nucleic acid molecules of the invention is intended to mean two or more proteins or nucleic acid molecules having a common structural domain or motif and having sufficient amino acid or nucleotide sequence homology as defined herein. Such family members can be naturally or non-naturally occurring and can be from either the same or different species. For example, a family can contain a first protein of human origin, as well as other, distinct proteins of human origin or alternatively, can contain homologues of non-human origin, e.g., monkey proteins. Members of a family may also have common functional characteristics.

For example, the family of SCDR proteins comprises at least one "transmembrane domain". As used herein, the term "transmembrane domain" includes an amino acid sequence of about 15 amino acid residues in length which spans the plasma membrane. More preferably, a transmembrane domain includes about at least 20, 25, 30, 35, 40, or 45 amino acid residues and spans the plasma membrane. Transmembrane domains are rich in hydrophobic residues, and typically have an alpha-helical structure. In a preferred embodiment, at least 50%, 60%, 70%, 80%, 90%, 95% or more of the amino acids of a transmembrane domain are hydrophobic, e.g., leucines, isoleucines, tyrosines, or tryptophans. Transmembrane domains are described in, for example, Zagotta W. N. et al., (1996) Annual Rev. Neurosci. 19: 235-263, the contents of which are incorporated herein by reference. Amino acid residues 144-162 of the native SCDR protein are predicted to comprise a transmembrane domain. Accordingly, SCDR proteins having at least 50-60% homology, preferably about 60-70%, more preferably about 70-80%, or about 80-90% homology with a transmembrane domain of human SCDR are within the scope of the invention.

In another embodiment, a SCDR molecule of the present invention is identified based on the presence of a "short-chain dehydrogenase catalytic motif" in the protein or corresponding nucleic acid molecule. As used herein, the term "short-chain dehydrogenase catalytic motif" includes an amino acid sequence which is involved in the catalytic activity of short-chain dehydrogenase molecules, and which is strictly conserved among short-chain dehydrogenases. The short-chain dehydrogenase catalytic motif has an amino acid consensus sequence of YXXXK (SEQ ID NO:115), where X can be any amino acid (Zhang and Underwood (1999) Biochim. Biophys. Acta 1435: 184-190; Duax et al. (2000) Vitam. Hormon. 58: 121-148; Jornvall et al., (1995) Biochemistry 34: 6003-6013; and Persson et al. (1991) Eur. J. Biochem. 200(2), 537-543). A short-chain dehydrogenase catalytic motif is found in the amino acid sequence of human SCDR from residues 201-205 of SEQ ID NO:113.

In another embodiment, a SCDR molecule of the present invention is identified based on the presence of a "short-chain dehydrogenase cofactor-binding motif" in the protein or corresponding nucleic acid molecule. As used herein, the term "short-chain dehydrogenase cofactor-binding motif" includes an amino acid sequence which is involved in the binding of a cofactor molecule (e.g., $NAD^+$ or $NADP^+$), and which is strictly conserved among short-chain dehydrogenase family members. The short-chain dehydrogenase cofactor-binding motif has an amino acid consensus sequence of GXXXGXG (SEQ ID NO:116), where X can be any amino acid (Zhang and Underwood (1999) Biochim. Biophys. Acta 1435: 184-190; Duax et al. (2000) Vitam. Hormon. 58: 121-148; Jornvall et al., (1995) Biochemistry 34: 6003-6013; and Persson et al. (1991) Eur. J. Biochem. 200(2), 537-543). A short-chain dehydrogenase cofactor-binding motif is found in the amino acid sequence of human SCDR from residues 47-53 of SEQ ID NO:113.

In another embodiment, a SCDR molecule of the present invention is identified based on the presence of a "short-chain dehydrogenase domain" in the protein or corresponding nucleic acid molecule. As used herein, the term "short-chain dehydrogenase domain" includes a protein domain having an amino acid sequence of about 100-300 amino acid residues, and a bit score of at least 72.8. Preferably, an aldehyde dehydrogenase family domain includes at least about 150-250, or more preferably about 195 amino acid residues, and has a bit score of at least 20, 25, 30, 35, 40, 45, 50, 55, 60, 65, 70, or more. To identify the presence of a short-chain dehydrogenase domain in a SCDR protein, and make the determination that a protein of interest has a particular profile, the amino acid sequence of the protein may be searched against a database of known protein domains (e.g., the HMM database). The short-chain dehydrogenase domain (HMM) has been assigned the PFAM Accession PF00106. A search was performed against the HMM database resulting in the identification of a "short-chain dehydrogenase" domain in the amino acid sequence of human SCDR (SEQ ID NO:113) at about residues 41-235 of SEQ ID NO:113.

In another embodiment, a SCDR molecule of the present invention is identified based on the presence of an "oxidoreductase protein dehydrogenase domain" in the protein or corresponding nucleic acid molecule. As used herein, the term "oxidoreductase protein dehydrogenase domain" includes a protein domain having an amino acid sequence of about 50-200 amino acid residues and having a bit score for the alignment of the sequence to the oxidoreductase protein dehydrogenase domain of at least 81. Preferably, an oxidoreductase protein dehydrogenase domain includes at least about 100-150, or more preferably about 134 amino acid residues, and has a bit score for the alignment of the sequence to the oxidoreductase protein dehydrogenase domain of at least 20, 25, 30, 35, 40, 45, 50, 55, 60, 65, 70, 80, or higher. The oxidoreductase protein dehydrogenase domain has been assigned ProDom entry 11. To identify the presence of an oxidoreductase protein dehydrogenase domain in a SCDR protein, and to make the determination that a protein of interest has a particular profile, the amino acid sequence of the protein may be searched against a database of known protein domains (e.g., the ProDom database) using the default parameters. A search was performed against the ProDom database resulting in the identification of an oxidoreductase protein dehydrogenase domain in the amino acid sequence of human SCDR (SEQ ID NO:113) at about residues 34-167 of SEQ ID NO:113.

In another embodiment, a SCDR molecule of the present invention is identified based on the presence of a "ketoreductase domain" in the protein or corresponding nucleic acid molecule. As used herein, the term "ketoreductase domain" includes a protein domain having an amino acid sequence of about 10-100 amino acid residues and having a bit score for the alignment of the sequence to the ketoreductase domain of at least 72. Preferably, a ketoreductase domain includes at least about 25-75, or more preferably about 50 amino acid residues, and has a bit score for the alignment of the sequence to the ketoreductase domain of at least 20, 25, 30, 35, 40, 45, 50, 55, 60, 65, 70, or higher. The ketoreductase domain has been assigned ProDom entry 82527. To identify the presence of a ketoreductase domain in a SCDR protein, and to make the determination that a protein of interest has a particular profile, the amino acid sequence of the protein may be searched against a database of known protein domains (e.g., the ProDom database) using the default parameters. A search was performed against the ProDom database resulting in the identification of a ketoreductase domain in the amino acid sequence of human SCDR (SEQ ID NO:113) at about residues 238-287 of SEQ ID NO:113.

In a preferred embodiment, the SCDR molecules of the invention include at least one or more of the following domains: a transmembrane domain, a short-chain dehydrogenase catalytic motif, a short-chain dehydrogenase cofactor-binding motif, a short-chain dehydrogenase domain, an oxidoreductase protein dehydrogenase domain, and a ketoreductase domain.

Isolated proteins of the present invention, preferably SCDR proteins, have an amino acid sequence sufficiently identical to the amino acid sequence of SEQ ID NO:113, or are encoded by a nucleotide sequence sufficiently identical to SEQ ID NO:112 or 114. As used herein, the term "sufficiently identical" refers to a first amino acid or nucleotide sequence which contains a sufficient or minimum number of identical or equivalent (e.g., an amino acid residue which has a similar side chain) amino acid residues or nucleotides to a second amino acid or nucleotide sequence such that the first and second amino acid or nucleotide sequences share common structural domains or motifs and/or a common functional activity. For example, amino acid or nucleotide sequences which share common structural domains have at least 30%, 40%, or 50% homology, preferably 60% homology, more preferably 70%-80%, and even more preferably 90-95% homology across the amino acid sequences of the domains and contain at least one and preferably two structural domains or motifs, are defined herein as sufficiently identical. Furthermore, amino acid or nucleotide sequences which share at least 30%, 40%, or 50%, preferably 60%, more preferably 70-80%, or 90-95% homology and share a common functional activity are defined herein as sufficiently identical.

As used interchangeably herein, an "SCDR activity", "biological activity of SCDR" or "functional activity of SCDR", refers to an activity exerted by a SCDR protein, polypeptide or nucleic acid molecule on a SCDR responsive cell or tissue, or on a SCDR protein substrate, as determined in vivo, or in vitro, according to standard techniques. In one embodiment, a SCDR activity is a direct activity, such as an association with a SCDR-target molecule. As used herein, a "target molecule" or "binding partner" is a molecule with which a SCDR protein binds or interacts in nature, such that SCDR-mediated function is achieved. A SCDR target molecule can be a non-SCDR molecule or a SCDR protein or polypeptide of the present invention (e.g., $NAD^+$ or $NADP^+$, or other cofactor). In an exemplary embodiment, a SCDR target molecule is a SCDR ligand (e.g., an alcohol or a steroid). Alternatively, a SCDR activity is an indirect activity, such as a cellular signaling activity mediated by interaction of the SCDR protein with a SCDR ligand. The biological activities of SCDR are described herein. For example, the SCDR proteins of the present invention can have one or more of the following activities: 1) modulate metabolism and catabolism of biochemical molecules necessary for energy production or storage, 2) modulate intra- or intercellular signaling, 3) modulate metabolism or catabolism of metabolically important biomolecules, 4) modulate detoxification of potentially harmful compounds, and 5) modulate cellular proliferation and/or differentiation.

Accordingly, another embodiment of the invention features isolated SCDR proteins and polypeptides having a SCDR activity. Other preferred proteins are SCDR proteins having one or more of the following domains: a transmembrane domain, a short-chain dehydrogenase catalytic motif, a short-chain dehydrogenase cofactor-binding motif, a short-chain dehydrogenase domain, an oxidoreductase protein dehydrogenase domain, and a ketoreductase domain and, preferably, a SCDR activity.

Additional preferred proteins have at least one transmembrane domain, a short-chain dehydrogenase catalytic motif, a short-chain dehydrogenase cofactor-binding motif, a short-chain dehydrogenase domain, an oxidoreductase protein dehydrogenase domain, and a ketoreductase domain, and are, preferably, encoded by a nucleic acid molecule having a nucleotide sequence which hybridizes under stringent hybridization conditions to a nucleic acid molecule comprising the nucleotide sequence of SEQ ID NO:112 or 114.

Isolation of the 21657 (SCDR) cDNA

The invention is based, at least in part, on the discovery of a human gene encoding a novel protein, referred to herein as 21657 or SCDR. The human SCDR gene, which is approximately 1249 nucleotides in length, encodes a protein having a molecular weight of approximately 34.9 kD and which is approximately 317 amino acid residues in length. The entire sequence of human clone Fbh21657, was determined and found to contain an open reading frame termed human "SCDR", set forth in SEQ ID NO:112. The amino acid sequence of this human SCDR expression product is set forth in SEQ ID NO:113. The SCDR protein sequence set forth in SEQ ID NO:113 comprises about 317 amino acids. The coding region (open reading frame) of SEQ ID NO:112 is set forth as SEQ ID NO:114.

Analysis of the Human SCDR Molecules

The amino acid sequence of human SCDR was analyzed using the program PSORT to predict the localization of the protein within the cell. This program assesses the presence of different targeting and localization amino acid sequences within the query sequence. The results of the analyses show that human SCDR (SEQ ID NO:113) may be localized to the nucleus, to the mitochondrion, to the cytoplasm, or to the endoplasmic reticulum.

A search of the amino acid sequence of SCDR was performed against the Memsat database. This search resulted in the identification of one transmembrane domain in the amino acid sequence of human SCDR (SEQ ID NO:113) at about residues 144-162.

A search of the amino acid sequence of SCDR was also performed against the HMM database. This search resulted in the identification of a "short-chain dehydrogenase domain" in the amino acid sequence of SCDR (SEQ ID NO:113) at about residues 41-235 (score=72.8).

A search of the amino acid sequence of SCDR was also performed against the ProDom database. This search resulted in the identification of an "oxidoreductase protein dehydrogenase domain" in the amino acid sequence of human SCDR (SEQ ID NO:113) at about residues 34-167 (score=81), and also in the identification of a "ketoreductase domain" in the amino acid sequence of human SCDR (SEQ ID NO:113) at about residues 238-287 (score=72).

Tissue Distribution of SCDR mRNA

This example describes the tissue distribution of SCDR mRNA, as determined by Northern analysis, by Polymerase Chain Reaction (PCR) on cDNA libraries using oligonucleotide primers based on the human SCDR sequence, or by in situ analysis.

Northern blot hybridizations with the various RNA samples are performed under standard conditions and washed under stringent conditions, i.e., 0.2×SSC at 65° C. The DNA probe is radioactively labeled with $^{32}$P-dCTP using the Prime-It kit (Stratagene, La Jolla, Calif.) according to the instructions of the supplier. Filters containing human mRNA (MultiTissue Northern I and MultiTissue Northern II from Clontech, Palo Alto, Calif.) are probed in ExpressHyb hybridization solution (Clontech) and washed at high stringency according to manufacturer's recommendations.

SCDR expression in normal human and monkey tissues is assessed by PCR using the TaqMan® system (PE Applied Biosystems) according to the manufacturer's instructions.

For in situ analysis, various tissues, e.g. tissues obtained from brain, are first frozen on dry ice. Ten-micrometer-thick sections of the tissues are postfixed with 4% formaldehyde in DEPC treated 1× phosphate-buffered saline at room temperature for 10 minutes before being rinsed twice in DEPC 1× phosphate-buffered saline and once in 0.1 M triethanolamine-HCl (pH 8.0). Following incubation in 0.25% acetic anhydride-0.1 M triethanolamine-HCl for 10 minutes, sections are rinsed in DEPC 2×SSC (1×SSC is 0.15M NaCl plus 0.015M sodium citrate). Tissue is then dehydrated through a series of ethanol washes, incubated in 100% chloroform for 5 minutes, and then rinsed in 100% ethanol for 1 minute and 95% ethanol for 1 minute and allowed to air dry.

Hybridizations are performed with $^{35}$S-radiolabeled ($5 \times 10^7$ cpm/mi) cRNA probes. Probes are incubated in the presence of a solution containing 600 mM NaCl, 10 mM Tris (pH 7.5), 1 mM EDTA, 0.01% sheared salmon sperm DNA, 0.01% yeast tRNA, 0.05% yeast total RNA type X1, 1×Denhardt's solution, 50% formamide, 10% dextran sulfate, 100 mM dithiothreitol, 0.1% sodium dodecyl sulfate (SDS), and 0.1% sodium thiosulfate for 18 hours at 55° C.

After hybridization, slides are washed with 2×SSC. Sections are then sequentially incubated at 37° C. in TNE (a solution containing 10 mM Tris-HCl (pH 7.6), 500 mM NaCl, and 1 mM EDTA), for 10 minutes, in TNE with 10 µg of RNase A per ml for 30 minutes, and finally in TNE for 10 minutes. Slides are then rinsed with 2×SSC at room temperature, washed with 2×SSC at 50° C. for 1 hour, washed with 0.2×SSC at 55° C. for 1 hour, and 0.2×SSC at 60° C. for 1 hour. Sections are then dehydrated rapidly through serial ethanol-0.3 M sodium acetate concentrations before being air dried and exposed to Kodak Biomax MR scientific imaging film for 24 hours and subsequently dipped in NB-2 photoemulsion and exposed at 4° C. for 7 days before being developed and counter stained.

Tissue Distribution of Human SCDR mRNA Using TaqMan® Analysis

This example describes the tissue distribution of human SCDR mRNA in a variety of cells and tissues, as determined using the TaqMan® procedure. The TaqMan® procedure is a quantitative, reverse transcription PCR-based approach for detecting mRNA. The RT-PCR reaction exploits the 5' nuclease activity of AmpliTaq Gold™ DNA Polymerase to cleave a TaqMan® probe during PCR. Briefly, cDNA was generated from the samples of interest, e.g., various human tissue samples, and used as the starting material for PCR amplification. In addition to the 5' and 3' gene-specific primers, a gene-specific oligonucleotide probe (complementary to the region being amplified) was included in the reaction (i.e., the TaqMan® probe). The TaqMan® probe includes the oligonucleotide with a fluorescent reporter dye covalently linked to the 5' end of the probe (such as FAM (6-carboxyfluorescein), TET (6-carboxy-4,7,2',7'-tetrachlorofluorescein), JOE (6-carboxy-4,5-dichloro-2,7-dimethoxyfluorescein), or VIC) and a quencher dye (TAMRA (6-carboxy-N, N,N',N'-tetramethylrhodamine) at the 3' end of the probe.

During the PCR reaction, cleavage of the probe separates the reporter dye and the quencher dye, resulting in increased fluorescence of the reporter. Accumulation of PCR products is detected directly by monitoring the increase in fluorescence of the reporter dye. When the probe is intact, the proximity of the reporter dye to the quencher dye results in suppression of the reporter fluorescence. During PCR, if the target of interest is present, the probe specifically anneals between the forward and reverse primer sites. The 5'-3' nucleolytic activity of the AmpliTaq™ Gold DNA Polymerase cleaves the probe between the reporter and the quencher only if the probe hybridizes to the target. The probe fragments are then displaced from the target, and polymerization of the strand continues. The 3' end of the probe is blocked to prevent extension of the probe during PCR. This process occurs in every cycle and does not interfere with the exponential accumulation of product. RNA was prepared using the trizol method and treated with DNase to remove contaminating genomic DNA. cDNA was synthesized using standard techniques. Mock cDNA synthesis in the absence of reverse transcriptase resulted in samples with no detectable PCR amplification of the control gene confirms efficient removal of genomic DNA contamination.

Expression of SCDR mRNA was upregulated in various tumors. Lung, colon, and breast tumors demonstrated higher levels of SCDR expression than was observed for the corresponding normal tissues. Elevated expression of SCDR was also detected in Wilm's tumor, lymphangiona, endometrial polyps, and neuroblastoma tissue samples relative to the corresponding normal tissues.

Strong expression of SCDR was also detected in normal pancreas, brain cortex, and ovary tissues. In addition, SCDR expression was detected in normal tissues from kidney, adipose, brain hypothalamus, nerve, breast, prostate, colon, fetal kidney, skeletal muscle, skin, dorsal root ganglion, and fetal heart, in prostate epithelial cells, in glial cells, in tissues from heart (chronic heart failure), in liver fibrosis tissue, in hyperkeratotic skin tissue, and in prostate tumor tissue.

Human 42755

The present invention is based, at least in part, on the discovery of novel methyltransferase family members, referred to herein as "42755", "Methyltransferase-1" or "METH-1" nucleic acid and protein molecules. These novel molecules are capable of catalyzing the transfer of a methyl group to biological molecules (e.g., polypeptides) and, thus, play a role in or function in a variety of cellular processes, e.g., molecular aging, protein repair, protein methylation, gene expression, intra- and/or intercellular signaling, angiogenesis, and/or cellular proliferation, growth, differentiation, homeostasis, and/or migration. Thus, the METH-1 molecules of the present invention provide novel diagnostic targets and therapeutic agents to control methyltransferase-associated disorders, as defined herein.

The methyltransferase family is a large superfamily of enzymes that regulate biological processes by catalyzing the transfer of methyl groups to a wide variety of endogenous and exogenous compounds, including DNA, RNA, proteins, hormones, neurotransmitters, drugs, and xenobiotics (Weinshilboum, R. M. et al. (1999) *Annu. Rev. Pharmacol. Toxicol.* 39:19-52)

Methylation of DNA can play an important role in the control of gene expression in mammalian cells. The enzyme involved in this process is DNA methyltransferase, which catalyzes the transfer of a methyl group from S-adenosylmethionine to cytosine residues to form 5-methylcytosine, a modified base that is found mostly at CpG sites in the genome. The presence of methylated CpG islands in the promoter region of genes can suppress their expression. This process may be due to the presence of 5-methylcytosine, which apparently interferes with the binding of transcription factors or other DNA-binding proteins to block transcription. In different types of tumors, aberrant or accidental methylation of CpG islands in the promoter region has been observed for many cancer-related genes, resulting in the silencing of their expression. Such genes include tumor suppressor genes, genes that suppress metastasis and angiogenesis, and genes that repair DNA (Momparler, R. L. and Bovenzi, V. (2000) *J. Cell Physiol.* 183:145-54).

Methylation of proteins can play an important role in protein repair and reversal of protein aging. Proteins undergo a variety of spontaneous degradation processes, including oxidation, glycation, deamidation, isomerization, and racemization (Finch, C. E. (1990) *Longevity, Senescence, and the Genome* (Univ. of Chicago Press, Chicago); Harding, J. J. et al. (1989) *Mech. Aging Dev.* 50:7-16; Stadtman, E. R. (1990) *Biochemistry* 29:6323-6331; Stadtman, E. R. (1992) *Science* 257:1220-1224; Geiger, T. and Clarke, S. (1987) *J. Biol. Chem.* 262:785-794; Yuan, P. M. et al. (1981) *Mech. Agin. Dev.* 17:151-172; Wright, H. T. (1991) *Crit. Rev. Biochem. Mol. Biol.* 26:1-52; Visick, J. E. and Clarke, S. (1995) *Mol. Microbiol.* 16:835-845). These non-enzymatic modifications can produce functionally damaged species that reflect the action of aging at the molecular level (Stadtman (1992) supra; Martin, G. M. et al. (1996) *Nat. Genet.* 13:25-34).

Under physiological conditions, L-asparaginyl and L-aspartyl residues in polypeptides spontaneously degrade to L- and D-isoaspartyl and D-aspartyl residues (Geiger and Clarke (1987) supra; Stephenson, R. C. and Clarke, S. (1989) *J. Biol. Chem.* 264:6164-6170; Capasso, S. et al. (1991) *Pept. Res.* 4:234-238; Oliyai, C. and Borchardt, R. T. (1994) *Pharm. Res.* 11:751-758; Tyler-Cross, R. and Schirch, V. (1991) *J. Biol. Chem.* 266:22549-22556). These abnormal residues can affect both the structure and function of polypeptides and may underlie a portion of the aging-related loss of cellular and tissue function (Visick and Clarke (1995) supra; Noguchi, S. et al. (1998) *J. Mol. Biol.* 278:231-238; Catanzano, F. et al. (1997) *Protein Sci.* 6:1682-1693; Fujii, N. et al. (1994) *J. Biochem.* (Tokyo) 116:663-669).

The widely distributed protein L-isoaspartate (D-aspartate) O-methyltransferase (also called PCMT or PIMT) can initiate the conversion of L-isoaspartyl residues to L-aspartyl residues by forming the methyl ester of the L-isoaspartyl residue (Lowenson, J. D. and Clarke, S. (1995) in *Deamidation and Isoaspartate Formation in Peptides and Proteins* (Aswad, D. W., ed.) pp. 47-64, CRC Press, Boca Raton, Fla.). This ester is converted, in a nonenzymatic reaction, to an L-succinimidyl residue. Spontaneous hydrolysis of the L-succinimidyl residue produces either an L-aspartyl or an L-isoaspartyl residue. If an L-isoaspartyl residue is produced, additional rounds of methyl esterification, succinimide formation, and hydrolysis eventually convert it to an L-aspartyl residue (McFadden, P. N. and Clarke, S. (1987) *Proc. Natl. Acad. Sci. USA* 84:2595:2599; Johnson, B. A. et al. (1987) *J. Biol. Chem.* 262:5622-5629; Galetti, P. et al. (1988) *Biochemistry* 27:1752-1757; Johnson, B. A. et al. (1987) *J. Biol. Chem.* 262:12283-12287; Brennan, T. V. et al. (1994) *J. Biol. Chem.* 269:24586-24595).

Mice lacking functional protein L-isoaspartate (D-aspartate) O-methyltransferase show significant growth retardation, and they succumb to fatal seizures at an average of 42 days after birth (Kim, E. et al. (1997) *Proc. Natl. Acad. Sci. USA* 94:6132-6137). These mice also show a decreased seizure threshold when challenged with a convulsant drug. Analysis of tissues from these mice reveals a striking accumulation of damaged proteins which are substrates for protein L-isoaspartate (D-aspartate) O-methyltransferase (Kim, E. et al. (1997) *Proc. Natl. Acad. Sci. USA* 94:6132-6137).

The term "family" when referring to the protein and nucleic acid molecules of the invention is intended to mean two or more proteins or nucleic acid molecules having a common structural domain or motif and having sufficient amino acid or nucleotide sequence homology as defined herein. Such family members can be naturally or non-naturally occurring and can be from either the same or different species. For example, a family can contain a first protein of human origin as well as other distinct proteins of human origin or alternatively, can contain homologues of non-human origin, e.g., rat or mouse proteins. Members of a family can also have common functional characteristics.

For example, the family of METH-1 proteins of the present invention comprises at least one "transmembrane domain". As used herein, the term "transmembrane domain" includes an amino acid sequence of about 15 amino acid residues in length which spans the plasma membrane. More preferably, a transmembrane domain includes about at least 20, 25, 30, 35, 40, or 45 amino acid residues and spans the plasma membrane. Transmembrane domains are rich in hydrophobic residues, and typically have an alpha-helical structure. In a preferred embodiment, at least 50%, 60%, 70%, 80%, 90%, 95% or more of the amino acids of a transmembrane domain are hydrophobic, e.g., leucines, isoleucines, tyrosines, or tryptophans. Transmembrane domains are described in, for example, Zagotta, W. N. et al. (1996) *Annu. Rev. Neurosci.* 19:235-263, the contents of which are incorporated herein by reference. Amino acid residues 87-107 of the human METH-1 protein (SEQ ID NO:118) are predicted to comprise a transmembrane domain.

In another embodiment, members of the METH-1 family of proteins include at least one "protein-L-isoaspartate(D-aspartate) O-methyltransferase domain" or "PCMT domain" in the protein or corresponding nucleic acid molecule. As used interchangeably herein, the terms "protein-L-isoaspartate(D-aspartate) O-methyltransferase domain" or "PCMT domain" include a protein domain having at least about 130-300 amino acid residues and a bit score of at least 4 when compared against a PCMT Hidden Markov Model (HMM), e.g., PFAM Accession Number PF01135. Preferably, a PCMT domain includes a protein having an amino acid sequence of about 150-280, 170-260, 190-240, or more preferably about 216 amino acid residues, and a bit score of at least 8, 12, 16, 20, or more preferably, 21.9. To identify the presence of a PCMT domain in a METH-1 protein, and make the determination that a protein of interest has a particular profile, the amino acid sequence of the protein is searched against a database of known protein domains (e.g., the HMM database). The PCMT domain (HMM) has been assigned the PFAM Accession number PF01135 (see the PFAM website, available online through Washington University in St. Louis). A search was performed against the HMM database resulting in the identification of a PCMT domain in the amino acid sequence of human METH-1 at about residues 9-224 of SEQ ID NO: 118.

Preferably a "PCMT domain" is at least about 130-300 amino acid residues and has a "PCMT domain activity", for example, the ability to interact with a substrate molecule (e.g., a protein), transfer a methyl group to a protein (e.g., to an L-isoaspartyl residue within the protein), convert an L-isoaspartyl residue to an L-aspartyl residue, repair proteins, retard or reverse molecular aging, modulate intracellular signaling, and/or modulate cellular growth or differentiation. Accordingly, identifying the presence of a "PCMT domain" can include isolating a fragment of a METH-1 molecule (e.g., a METH-1 polypeptide) and assaying for the ability of the fragment to exhibit one of the aforementioned PCMT domain activities.

A description of the Pfam database can be found in Sonhammer et al. (1997) *Proteins* 28:405-420, and a detailed description of HMMs can be found, for example, in Gribskov et al. (1990) *Methods Enzymol.* 183:146-159; Gribskov et al. (1987) *Proc. Natl. Acad. Sci. USA* 84:4355-4358; Krogh et al. (1994) *J. Mol. Biol.* 235:1501-1531; and Stultz et al. (1993) *Protein Sci.* 2:305-314, the contents of which are incorporated herein by reference.

Isolated proteins of the present invention, preferably METH-1 proteins, have an amino acid sequence sufficiently homologous to the amino acid sequence of SEQ ID NO:118, or are encoded by a nucleotide sequence sufficiently homologous to SEQ ID NO:117 or 119. As used herein, the term "sufficiently homologous" refers to a first amino acid or nucleotide sequence which contains a sufficient or minimum number of identical or equivalent (e.g., an amino acid residue which has a similar side chain) amino acid residues or nucleotides to a second amino acid or nucleotide sequence such that the first and second amino acid or nucleotide sequences share common structural domains or motifs and/or a common functional activity. For example, amino acid or nucleotide sequences which share common structural domains having at least 50%, 55%, 60%, 65%, 70%, 75%, 80%, 85%, 90%, 91%, 92%, 93%, 94%, 95%, 96%, 97%, 98%, 99%, 99.5% or more homology or identity across the amino acid sequences of the domains and contain at least one and preferably two structural domains or motifs, are defined herein as sufficiently homologous. Furthermore, amino acid or nucleotide sequences which share at least 50%, 55%, 60%, 65%, 70%, 75%, 80%, 85%, 90%, 91%, 92%, 93%, 94%, 95%, 96%, 97%, 98%, 99%, 99.5% or more homology or identity and share a common functional activity are defined herein as sufficiently homologous.

In a preferred embodiment, a METH-1 protein includes at least one PCMT domain and/or one transmembrane domain and has an amino acid sequence at least about 50%, 55%, 60%, 65%, 70%, 75%, 80%, 85%, 90%, 91%, 92%, 93%, 94%, 95%, 96%, 97%, 98%, 99%, 99.5% or more homologous or identical to the amino acid sequence of SEQ ID NO:118. In yet another preferred embodiment, a METH-1 protein includes at least one PCMT domain and/or one transmembrane domain and is encoded by a nucleic acid molecule having a nucleotide sequence which hybridizes under stringent hybridization conditions to a complement of a nucleic acid molecule comprising the nucleotide sequence of SEQ ID NO:117 or 119. In another preferred embodiment, a METH-1 protein includes at least one PCMT domain and/or one transmembrane domain and has a METH-1 activity.

As used interchangeably herein, a "METH-1 activity", "biological activity of METH-1" or "functional activity of METH-1", includes an activity exerted or mediated by a METH-1 protein, polypeptide or nucleic acid molecule on a METH-1 responsive cell or on a METH-1 substrate, as determined in vivo or in vitro, according to standard techniques. In one embodiment, a METH-1 activity is a direct activity, such as an association with a METH-1 target molecule. As used herein, a "target molecule" or "binding partner" is a molecule with which a METH-1 protein binds or interacts in nature, such that METH-1-mediated function is achieved. A METH-1 target molecule can be a non-METH-1 molecule or a METH-1 protein or polypeptide of the present invention. In an exemplary embodiment, a METH-1 target molecule is a METH-1 substrate or ligand. A METH-1 activity can also be an indirect activity, such as a cellular signaling activity mediated by interaction of the METH-1 protein with a METH-1 substrate or ligand (e.g., angiogenesis).

In a preferred embodiment, a METH-1 activity is at least one of the following activities: (i) interaction with a METH-1 substrate or target molecule (e.g., a non-METH-1 protein); (ii) conversion of a METH-1 substrate or target molecule to a product (e.g., transfer of a methyl group to the substrate or target molecule); (iii) interaction with and/or methyl transfer to a second non-METH-1 protein; (iv) conversion of an L-isoaspartyl residue to an L-aspartyl residue; (v) modulation of protein repair pathways; (vi) repair of proteins; (vii) retardation or reversal of molecular aging; (viii) modulation of intra- or intercellular signaling and/or gene transcription (e.g., either directly or indirectly); (ix) modulation of central nervous system function; (x) modulation of cellular proliferation, growth, homeostasis, differentiation, and/or migration; and/or (xi) modulation of angiogenesis.

As used interchangeably herein, a "methyltransferase-associated disorder" or a "METH-1-associated disorder" includes a disorder, disease or condition which is caused or characterized by a misregulation (e.g., downregulation or upregulation) of methyltransferase activity. Methyltransferase-associated disorders can detrimentally affect cellular functions such as angiogenesis, cellular proliferation, growth, differentiation, angiogenesis, or migration, inter- or intra-cellular communication; tissue function, such as cardiac function or musculoskeletal function; systemic responses in an organism, such as nervous system responses, hormonal responses (e.g., insulin response), or immune responses; and protection of cells from toxic compounds (e.g., carcinogens, toxins, or mutagens).

Examples of methyltransferase-associated disorders include cellular proliferation, growth, differentiation, or migration disorders. Cellular proliferation, growth, differentiation, or migration disorders include those disorders that affect cell proliferation, growth, differentiation, or migration processes. As used herein, a "cellular proliferation, growth, differentiation, or migration process" is a process by which a cell increases in number, size or content, by which a cell develops a specialized set of characteristics which differ from that of other cells, or by which a cell moves closer to or further from a particular location or stimulus. The METH-1 molecules of the present invention are involved in protein repair mechanisms, which are known to be involved in cellular growth, differentiation, and migration processes. Thus, the METH-1 molecules may modulate cellular growth, differentiation, or migration, and may play a role in disorders characterized by aberrantly regulated growth, differentiation, or migration. Such disorders include cancer, e.g., carcinoma, sarcoma, or leukemia; tumor metastasis; skeletal dysplasia; hepatic disorders; and hematopoietic and/or myeloproliferative disorders.

Isolation of the Human 42755 (METH-1) cDNA

The invention is based, at least in part, on the discovery of genes encoding novel members of the methyltransferase family. The entire sequence of human clone Fbh42755 was determined and found to contain an open reading frame termed human "METH-1".

The nucleotide sequence encoding the human METH-1 is set forth as SEQ ID NO:117. The human METH-1 gene, which is approximately 1872 nucleotides in length, encodes a protein having a molecular weight of approximately 39.4 kD and which is approximately 357 amino acid residues in length (SEQ ID NO:118). The coding region (open reading frame) of SEQ ID NO:117 is set forth as SEQ ID NO:119.

Analysis of the human 42755 (METH-1) Molecules

The amino acid sequence of human METH-1 was analyzed using the program PSORT (available online; see Nakai, K. and Kanehisa, M. (1992) *Genomics* 14:897-911) to predict the localization of the proteins within the cell. This program assesses the presence of different targeting and localization amino acid sequences within the query sequence. The results of the analyses show that human METH-1 is predicted to be localized to the nucleus.

Analysis of the amino acid sequence of human METH-1 was performed using MEMSAT. This analysis resulted in the identification of one transmembrane domain in the amino acid sequence of human METH-1 at residues 87-107 of SEQ ID NO:118.

Searches of the amino acid sequence of human METH-1 were also performed against the HMM database. These searches resulted in the identification of a "PCMT domain" at about residues 9-224 of SEQ ID NO:118 (score=21.9).

Searches of the amino acid sequence of human METH-1 were further performed against the Prosite database. These searches resulted in the identification in the amino acid sequence of human METH-1 (SEQ ID NO:118) of a potential glycosaminoglycan attachment site (amino acid residues 82-92), a potential tyrosine kinase phosphorylation site (amino acid residues 34-41), a potential cell attachment sequence (amino acid residues 38-40), three potential protein kinase C phosphorylation sites (amino acid residues 26-28, 254-256, and 346-348), three potential casein kinase II phosphorylation sites (amino acid residues 6-9, 223-226, and 302-305), and four potential N-myristoylation sites (amino acid residues 2-7, 88-93, 106-111, and 234-239).

Searches of the amino acid sequence of human METH-1 were still further performed against the ProDom database. These searches resulted in the identification of homology between human METH-1 and p99.2 (1) O61702_CAEEL// R119.5 PROTEIN.

Analysis of the Tissue Distribution of 42755 (METH-1) mRNA Using In Situ Analysis This example describes the tissue distribution of human METH-1 mRNA, as may be determined using in situ hybridization analysis. For in situ analysis, various tissues, e.g., tissues obtained from brain, are first frozen on dry ice. Ten-micrometer-thick sections of the tissues are postfixed with 4% formaldehyde in DEPC-treated 1× phosphate-buffered saline at room temperature for 10 minutes before being rinsed twice in DEPC 1× phosphate-buffered saline and once in 0.1 M triethanolamine-HCl (pH 8.0). Following incubation in 0.25% acetic anhydride-0.1 M triethanolamine-HCl for 10 minutes, sections are rinsed in DEPC 2×SSC (1×SSC is 0.15 M NaCl plus 0.015 M sodium citrate). Tissue is then dehydrated through a series of ethanol washes, incubated in 100% chloroform for 5 minutes, and then rinsed in 100% ethanol for 1 minute and 95% ethanol for 1 minute and allowed to air dry.

Hybridizations are performed with $^{35}$S-radiolabeled ($5\times10^7$ cpm/ml) cRNA probes. Probes are incubated in the presence of a solution containing 600 mM NaCl, 10 mM Tris (pH 7.5), 1 mM EDTA, 0.01% sheared salmon sperm DNA, 0.01% yeast tRNA, 0.05% yeast total RNA type X1, 1×Denhardt's solution, 50% formamide, 10% dextran sulfate, 100 mM dithiothreitol, 0.1% sodium dodecyl sulfate (SDS), and 0.1% sodium thiosulfate for 18 hours at 55° C.

After hybridization, slides are washed with 2×SSC. Sections are then sequentially incubated at 37° C. in TNE (a solution containing 10 mM Tris-HCl (pH 7.6), 500 mM NaCl, and 1 mM EDTA), for 10 minutes, in TNE with 10 µg of RNase A per ml for 30 minutes, and finally in TNE for 10 minutes. Slides are then rinsed with 2×SSC at room temperature, washed with 2×SSC at 50° C. for 1 hour, washed with 0.2×SSC at 55° C. for 1 hour, and 0.2×SSC at 60° C. for 1 hour. Sections are then dehydrated rapidly through serial ethanol-0.3 M sodium acetate concentrations before being air dried and exposed to Kodak Biomax MR scientific imaging film for 24 hours and subsequently dipped in NB-2 photoemulsion and exposed at 4° C. for 7 days before being developed and counter stained.

Analysis of Human 42755 (METH-1) Expression using the TaqMan® Procedure

The TaqMan® procedure is a quantitative, real-time PCR-based approach to detecting mRNA. The RT-PCR reaction exploits the 5' nuclease activity of AmpliTaq Gold™ DNA Polymerase to cleave a TaqMan® probe during PCR. Briefly, cDNA was generated from the samples of interest and served as the starting material for PCR amplification. In addition to the 5' and 3' gene-specific primers, a gene-specific oligonucleotide probe (complementary to the region being amplified) was included in the reaction (i.e., the TaqMan® probe). The TaqMan® probe included an oligonucleotide with a fluorescent reporter dye covalently linked to the 5' end of the probe (such as FAM (6-carboxyfluorescein), TET (6-carboxy-4,7,2',7'-tetrachlorofluorescein), JOE (6-carboxy-4,5-dichloro-2,7-dimethoxyfluorescein), or VIC) and a quencher dye (TAMRA (6-carboxy-N,N,N',N'-tetramethylrhodamine) at the 3' end of the probe.

During the PCR reaction, cleavage of the probe separated the reporter dye and the quencher dye, resulting in increased fluorescence of the reporter. Accumulation of PCR products was detected directly by monitoring the increase in fluorescence of the reporter dye. When the probe was intact, the proximity of the reporter dye to the quencher dye resulted in suppression of the reporter fluorescence. During PCR, if the target of interest was present, the probe specifically annealed between the forward and reverse primer sites. The 5'-3' nucleolytic activity of the AmpliTaq™ Gold DNA Polymerase cleaved the probe between the reporter and the quencher only if the probe hybridized to the target. The probe fragments were then displaced from the target, and polymerization of the strand continued. The 3' end of the probe was blocked to prevent extension of the probe during PCR. This process occurred in every cycle and did not interfere with the exponential accumulation of product. RNA was prepared using the trizol method and treated with DNase to remove contaminating genomic DNA. cDNA was synthesized using standard techniques. Mock cDNA synthesis in the absence of reverse transcriptase resulted in samples with no detectable PCR amplification of the control GAPDH or m-actin gene confirming efficient removal of genomic DNA contamination.

The expression of human 42755 (METH-1) was examined in various human tissue and cell types using TaqMan® analysis. As set forth below in Table 26, human METH-1 is highly expressed in kidney, skeletal muscle, pancreas, normal brain cortex, hypothalamus, glial cells (astrocytes), ovary, and prostate epithelial cells.

TABLE 26

| Tissue Type | Mean | β2 Mean | ∂∂ Ct | Expression |
|---|---|---|---|---|
| 1. Artery normal | 33.59 | 22.73 | 10.64 | 0.6288 |
| 2. Vein normal | 33.16 | 20.55 | 12.4 | 0.185 |
| 3. Aortic smooth muscle cells (SMC) - early | 27.97 | 20.22 | 7.54 | 5.3919 |
| 4. Coronary SMC | 29.64 | 23.66 | 5.75 | 18.5171 |
| 5. Static human umbilical vein endothelial cells (HUVEC) | 27.72 | 21.14 | 6.36 | 12.1744 |
| 6. Shear HUVEC | 27.63 | 21.25 | 6.16 | 13.9848 |
| 7. Heart normal | 25.61 | 19.24 | 6.14 | 14.1309 |
| 8. Heart congestive heart failure (CHF) | 25.61 | 19.81 | 5.58 | 20.9777 |
| 9. Kidney | 25.38 | 21.16 | 3.99 | 62.9347 |

TABLE 26-continued

| Tissue Type | Mean | β2 Mean | ∂∂ Ct | Expression |
|---|---|---|---|---|
| 10. Skeletal Muscle | 26.27 | 21.87 | 4.18 | 55.1689 |
| 11. Adipose normal | 29.7 | 20.1 | 9.38 | 1.4957 |
| 12. Pancreas | 25.91 | 22.16 | 3.52 | 86.8699 |
| 13. primary osteoblasts | 29.42 | 19.69 | 9.51 | 1.3715 |
| 14. Osteoclasts (differentiated) | 30.7 | 18.14 | 12.35 | 0.1922 |
| 15. Skin normal | 28.63 | 21.73 | 6.68 | 9.7526 |
| 16. Spinal cord normal | 27.97 | 20.39 | 7.37 | 6.0662 |
| 17. Brain Cortex normal | 25.3 | 21.81 | 3.27 | 103.3063 |
| 18. Brain Hypothalamus normal | 26.17 | 21.75 | 4.2 | 54.5983 |
| 19. Nerve | 29.95 | 24.54 | 5.18 | 27.489 |
| 20. DRG (Dorsal Root Ganglion) | 28.43 | 22.53 | 5.67 | 19.5729 |
| 21. Glial Cells (Astrocytes) | 27.24 | 22.59 | 4.43 | 46.3914 |
| 22. Glioblastoma | 28.42 | 18.76 | 9.44 | 1.4397 |
| 23. Breast normal | 32.13 | 21.3 | 10.62 | 0.6376 |
| 24. Breast tumor | 24.79 | 19.04 | 5.54 | 21.5675 |
| 25. Ovary normal | 25.03 | 20.95 | 3.87 | 68.6308 |
| 26. Ovary Tumor | 28.9 | 20.82 | 7.85 | 4.3343 |
| 27. Prostate Normal | 28.17 | 20.07 | 7.88 | 4.2598 |
| 28. Prostate Tumor | 26.71 | 18.64 | 7.86 | 4.3193 |
| 29. Epithelial Cells (Prostate) | 26.75 | 21.68 | 4.84 | 34.7944 |
| 30. Colon normal | 27.29 | 18.9 | 8.17 | 3.472 |
| 31. Colon Tumor | 25.31 | 19.41 | 5.68 | 19.5052 |
| 32. Lung normal | 30.77 | 19.26 | 11.3 | 0.398 |
| 33. Lung tumor | 26.95 | 19.2 | 7.54 | 5.3919 |
| 34. Lung - chronic obstructive pulmonary disease (COPD) | 28.32 | 19.29 | 8.8 | 2.2358 |
| 35. Colon - inflammatory bowel disease (IBD) | 30.86 | 18.92 | 11.73 | 0.2954 |
| 36. Liver normal | 28.97 | 20.59 | 8.16 | 3.4841 |
| 37. Liver fibrosis | 29.38 | 22.43 | 6.72 | 9.4531 |
| 38. Dermal Cells - fibroblasts | 29.36 | 20.12 | 9.03 | 1.9196 |
| 39. Spleen normal | 27.3 | 20.16 | 6.92 | 8.258 |
| 40. Tonsil normal | 26.22 | 17.96 | 8.04 | 3.7994 |
| 41. Lymph node | 25.8 | 19.25 | 6.33 | 12.4303 |
| 42. Small Intestine | 28.75 | 20.36 | 8.17 | 3.472 |
| 43. Skin - Decubitus | 26.99 | 21.34 | 5.42 | 23.2762 |
| 44. Synovium | 30.7 | 21.16 | 9.32 | 1.5646 |
| 2. BM-MNC (Bone marrow mononuclear cells) | 24.7 | 17.53 | 6.96 | 8.06 |
| 45. Activated peripheral blood mononuclear cells (PBMC) | 28.34 | 16.61 | 11.52 | 0.3417 |

The expression of human METH-1 was further examined in various tumorigenic cell lines using TaqMan® analysis. The results are set forth below in Table 27. The cell lines analyzed in Table 27 are as follows: MCF-7, ZR75, T47D, MDA 231, and MDA 435 are human breast cancer cell lines; DLD-1, SW 480, SW 620, HCT 116, HT 29, and Colo 205 are human colon cancer cell lines; NCIH 125, NCIH 67, NCIH 322, NCIH 460, and A549 are human lung cancer cell lines; NHBE is a normal human bronchial epithelium cell line; SKOV-3 and OVCAR-3 are human ovarian cancer cell lines; and 293 and 293T are human embryonic kidney cell lines.

TABLE 27

| | Average 42755 | Average B-2 | ΔCt | Relative Expression |
|---|---|---|---|---|
| 1. MCF-7 | 25.2 | 20.3 | 5.0 | 31.7 |
| 2. ZR75 | 24.4 | 19.9 | 4.5 | 44.8 |
| 3. T47D | 25.1 | 19.3 | 5.8 | 17.9 |
| 4. MDA 231 | 29.1 | 18.4 | 10.7 | 0.6 |
| 5. MDA 435 | 26.3 | 17.3 | 9.0 | 1.9 |
| 6. DLD-1 | 24.9 | 21.0 | 3.9 | 67.9 |
| 7. SW 480 | 26.5 | 17.6 | 8.9 | 2.1 |

TABLE 27-continued

| | Average 42755 | Average B-2 | ΔCt | Relative Expression |
|---|---|---|---|---|
| 8. SW 620 | 25.1 | 19.1 | 6.0 | 16.0 |
| 9. HCT 116 | 26.5 | 19.4 | 7.1 | 7.3 |
| 10. HT 29 | 25.2 | 16.9 | 8.3 | 3.2 |
| 11. Colo 205 | 25.7 | 16.2 | 9.5 | 1.4 |
| 12. NCIH 125 | 24.8 | 19.0 | 5.8 | 18.1 |
| 13. NCIH 67 | 23.6 | 19.1 | 4.6 | 42.1 |
| 14. NCIH 322 | 24.9 | 19.6 | 5.3 | 25.3 |
| 15. NCIH 460 | 25.6 | 18.5 | 7.0 | 7.7 |
| 16. A549 | 25.2 | 19.9 | 5.3 | 24.7 |
| 17. NHBE | 25.6 | 20.0 | 5.6 | 21.3 |
| 18. SKOV-3 | 24.7 | 18.3 | 6.4 | 11.9 |
| 19. OVCAR-3 | 26.3 | 21.3 | 4.9 | 32.5 |
| 20. 293 | 26.3 | 21.9 | 4.4 | 47.2 |
| 21. 293T | 26.9 | 22.4 | 4.5 | 44.2 |

The expression of human METH-1 was also examined in various clinical tumors and angiogenic samples using the TaqMan® procedure. As set forth below in Table 28, human METH-1 is downregulated in 3/4 brain tumors, as compared to normal brain. Human METH-1 is also upregulated in proliferating human microvascular endothelial cells (HMVECs), as compared to arrested HMVECs.

TABLE 28

| | Average 42755 | Average Beta 2 | DD Ct | Relative Expression |
|---|---|---|---|---|
| 1. Colon normal | 27.79 | 17.97 | 11.60 | 0.32 |
| 2. Colon normal | 30.88 | 18.88 | 13.77 | 0.07 |
| 3. Colon normal | 26.73 | 18.81 | 9.69 | 1.21 |
| 4. Colon normal | 29.93 | 16.99 | 14.71 | 0.04 |
| 5. Colon tumor | 24.40 | 18.64 | 7.53 | 5.43 |
| 6. Colon tumor | 25.45 | 15.74 | 11.49 | 0.35 |
| 7. Colon tumor | 26.49 | 17.47 | 10.79 | 0.56 |
| 8. Colon tumor | 25.67 | 17.38 | 10.06 | 0.94 |
| 9. Colon tumor | 29.70 | 16.35 | 15.12 | 0.03 |
| 10. Colon tumor | 27.04 | 18.47 | 10.34 | 0.77 |
| 11. Liver metastasis | 25.14 | 17.43 | 9.49 | 1.40 |
| 12. Liver metastasis | 25.61 | 19.94 | 7.44 | 5.78 |
| 13. Liver metastasis | 24.98 | 18.34 | 8.41 | 2.94 |
| 14. Liver metastasis | 25.56 | 17.95 | 9.38 | 1.50 |
| 15. Liver normal | 26.39 | 16.53 | 11.64 | 0.31 |
| 16. Liver normal | 29.21 | 22.94 | 8.04 | 3.79 |
| 17. Brain normal | 28.09 | 22.92 | 6.94 | 8.14 |
| 18. Brain normal | 26.96 | 22.50 | 6.22 | 13.37 |
| 19. Brain normal | 28.78 | 24.01 | 6.54 | 10.75 |
| 20. Brain normal | 26.59 | 21.51 | 6.85 | 8.70 |
| 21. Astrocytes | 25.88 | 19.26 | 8.40 | 2.97 |
| 22. Brain tumor | 29.70 | 19.37 | 12.11 | 0.23 |
| 23. Brain tumor | 26.17 | 16.39 | 11.56 | 0.33 |
| 24. Brain tumor | 27.02 | 19.79 | 9.00 | 1.95 |
| 25. Brain tumor | 25.48 | 20.67 | 6.58 | 10.49 |
| 26. human microvascular endothelial cells (HMVEC) - Arrested | 33.61 | 21.07 | 14.31 | 0.05 |
| 27. HMVEC - Proliferating | 25.27 | 17.49 | 9.55 | 1.33 |
| 28. Placenta | 27.12 | 19.58 | 9.31 | 1.58 |
| 29. Fetal Adrenal | 30.13 | 23.83 | 8.07 | 3.73 |
| 30. Fetal Adrenal | 31.17 | 25.45 | 7.50 | 5.54 |
| 31. Fetal Liver | 31.86 | 25.25 | 8.38 | 3.00 |
| 32. Fetal Liver | 26.71 | 21.18 | 7.30 | 6.35 |
| 33. Wilms tumor | 26.23 | 18.88 | 9.13 | 1.79 |
| 34. Renal tumor | 31.70 | 24.12 | 9.35 | 1.53 |
| 35. Endometrial adenocarcinoma (AC) | 28.13 | 22.71 | 7.19 | 6.87 |

The expression of human METH-1 was further examined in various human angiogenic samples using the TaqMan® procedure. As set forth below in Table 29, human METH-1 is highly expressed in hemangioma, kidney, Wilms Tumor, uterine adenocarcinoma, neuroblastoma, fetal kidney, and fetal heart.

TABLE 29

| | Average 42755 | Average Beta 2 | D Ct | Relative Expression |
|---|---|---|---|---|
| 1. Hemangioma | 24.4 | 19.3 | 5.1 | 28.9 |
| 2. Hemangioma | 21.4 | 20.1 | 1.3 | 407.5 |
| 3. Hemangioma | 24.0 | 19.7 | 4.3 | 51.3 |
| 4. Normal Kidney | 23.7 | 23.2 | 0.5 | 717.0 |
| 5. Renal Cell Carcinoma | 26.7 | 19.4 | 7.2 | 6.6 |
| 6. Wilms Tumor | 21.1 | 20.8 | 0.3 | 801.1 |
| 7. Wilms Tumor | 24.3 | 24.2 | 0.1 | 926.6 |
| 8. Skin | 29.5 | 21.3 | 8.2 | 3.4 |
| 9. Uterine Adenocarcinoma | 23.5 | 19.6 | 3.8 | 69.8 |
| 10. Neuroblastoma | 24.0 | 19.6 | 4.4 | 47.9 |
| 11. Fetal Adrenal | 24.2 | 18.1 | 6.1 | 14.5 |
| 12. Fetal Kidney | 24.6 | 21.0 | 3.6 | 81.9 |
| 13. Fetal Heart | 23.1 | 19.0 | 4.2 | 55.7 |
| 14. Normal Heart | 24.5 | 19.0 | 5.5 | 22.1 |
| 15. Cartilage | 29.9 | 24.0 | 5.8 | 17.4 |
| 16. Spinal cord | 25.7 | 20.4 | 5.3 | 24.6 |
| 17. lymphangioma | 29.0 | 23.5 | 5.5 | 21.5 |
| 18. Endometrial polyps | 31.2 | 25.1 | 6.1 | 14.2 |
| 19. Synovium (rheumatoid arthritis) | 30.7 | 22.4 | 8.3 | 3.2 |
| 20. Hyperkeratotic skin | 28.1 | 22.8 | 5.3 | 25.5 |

The expression of human METH-1 was also examined in a mouse model of angiogenesis using the TaqMan® procedure. Angiogenic islets, when treated with VEGF, form new vessels. As set forth below, human METH-1 is upregulated in angiogenic VEGF treated islets in the RIP-Tag mouse model (samples 5 and 6), as compared to parental plugs from surrounding tissue (samples 3 and 4).

TABLE 30

| Tissue Type | 42755 Mean | β2 Mean | ∂∂ Ct | Expression |
|---|---|---|---|---|
| 1. Islets Angiogenic | 24.99 | 14.67 | 10.32 | 0.78 |
| 2. Islets Tumor | 30.34 | 14.97 | 15.38 | 0.02 |
| 3. Xeno/Tumor Parental #1 | 23.64 | 15.14 | 8.5 | 2.76 |
| 4. Xeno/Tumor Parental #2 | 23.44 | 17.99 | 5.45 | 22.88 |
| 5. Xeno/Tumor + VEGF #1 | 22.97 | 18.66 | 4.31 | 50.42 |
| 6. Xeno/Tumor + VEGF #2 | 23.55 | 16.91 | 6.64 | 10.03 |
| 7. Spleen | 37.92 | 8.61 | 29.31 | 0.00 |
| 8. Heart | 33.92 | 9.18 | 24.75 | 0.00 |
| 9. Liver | 35.69 | 15.29 | 20.4 | 0.00 |
| 10. Kidney | 35.06 | 11.07 | 23.98 | 0.00 |
| 11. Brain | 25.79 | 15.11 | 10.68 | 0.61 |
| 12. Colon | 26.41 | 14.38 | 12.04 | 0.24 |
| 13. Islets Normal | 39.07 | 40 | −0.93 | 1905.28 |

Accordingly, 42755 proteins may mediate various disorders, including cellular proliferative and/or differentiative disorders, prostate disorders, ovarian disorders, kidney disorders, brain disorders, skeletal muscle disorders and heart/cardiovascular disorders.

Assay for Activity of a Methyltransferase Protein or Polypeptide

To determine the methyltransferase activity in a protein sample (e.g., a protein L-isoaspartate(D-aspartate) O-methyltransferase containing sample), the following assay is used. The protein sample (e.g., a substantially purified protein sample or a cell lysate) is incubated with and appropriate substrate (e.g., 0.8 mg of ovalbumin (a protein containing damaged aspartyl residues; Sigma, grade V)) in 0.2 M [bis(2 hydroxyethyl)amino]tris(hydroxymethyl)methane (BisTris)

buffer (pH 6.8) containing 10 μM S-adenosyl-L-[methyl-$^{14}$C] methionine (53 mCi/mmol; Amersham; 1 mCi=37 MBq) in a 40 μl volume at 37° C. for 15 minutes. NaOH (40 μl of a 0.2 M solution) is added to stop the reaction and hydrolyze the [$^{14}$C]methyl esters formed on ovalbumin to [$^{14}$C]methanol. The reaction mixture is immediately spotted onto a 4×1 cm piece of filter paper and incubated above 5 ml of Ready-Gel scintillation fluid (Beckman) in the neck of a sealed 20 ml scintillation vial at room temperature for 3 hours to allow [$^{14}$C]methanol to diffuse into the scintillation fluid. The filter is then removed, and the radioactivity in the scintillation fluid is counted. Enzyme activity is determined as a function of [$^{14}$C]methanol production. Incubations containing only S-adenosyl-L-[methyl-$^{14}$C]methionine, ovalbumin, and buffer constitute the blank for the assay; the radioactivity in the tubes (typically <5%) is subtracted from the total counts in the determination of enzyme activity.

Human 32229

The human 32229 sequence (SEQ ID NO:120, as recited below in the section entitled "Identification and Characterization of Human 32229 cDNA"), which is approximately 3300 nucleotides long including untranslated regions, contains a predicted methionine-initiated coding sequence of about 2394 nucleotides, including the termination codon. The coding sequence encodes a 797 amino acid protein (SEQ ID NO:121, as recited below in the section entitled "Identification and Characterization of Human 32229 cDNA").

Human 32229 contains the following regions or other structural features: an acyl-CoA dehydrogenase domain (PFAM Accession Number PF00441) located at about amino acid residues 502 to 529, 531 to 610, 624 to 638, and 642 to 793 of SEQ ID NO:121; one predicted N-glycosylation site (PS00001) at about amino acids 493 to 496 of SEQ ID NO:121; five predicted Protein Kinase C phosphorylation sites (PS00005) at about amino acids 120 to 122, 320 to 322, 385 to 387, 548 to 550, and 667 to 669 of SEQ ID NO:121; eight predicted Casein Kinase II phosphorylation sites (PS00006) located at about amino 226 to 229, 315 to 318, 376 to 379, 471 to 474, 495 to 498, 543 to 546, 548 to 551, and 701 to 704 of SEQ ID NO:121; two predicted tyrosine kinase phosphorylation sites (PS00007) from about amino acid 409 to 417, and 550 to 556 of SEQ ID NO:121; nine predicted N-myristoylation sites (PS00008) from about amino acid 17 to 22, 116 to 121, 252 to 257, 262 to 267, 278 to 283, 310 to 315, 467 to 472, 692 to 697, and 723 to 728 of SEQ ID NO:121; one predicted tyrosine protein kinase specific active-site signature (PS00109) at about amino acid 197 to 209 of SEQ ID NO:121; and one predicted eukaryotic thiol (cysteine) proteases histidine active site (PS00639) at about amino acid 657 to 667 of SEQ ID NO:121.

For general information regarding PFAM identifiers, PS prefix and PF prefix domain identification numbers, refer to Sonnhammer et al. (1997) *Protein* 28:405-420.

The 32229 protein contains a significant number of structural characteristics in common with members of the acyl-CoA dehydrogenase. The term "family" when referring to the protein and nucleic acid molecules of the invention means two or more proteins or nucleic acid molecules having a common structural domain or motif and having sufficient amino acid or nucleotide sequence homology as defined herein. Such family members can be naturally or non-naturally occurring and can be from either the same or different species. For example, a family can contain a first protein of human origin as well as other distinct proteins of human origin, or alternatively, can contain homologues of non-human origin, e.g., rat or mouse proteins. Members of a family can also have common functional characteristics.

Dehydrogenases are a large family of enzymes, involved in a wide variety of metabolic processes that catalyze the transfer of hydrogen and electrons from one compound to another. They include, inter alia, many enzymes of the citric acid cycle, including isocitrate dehydrogenase, 1-ketogluterate dehydrogenase, and malic dehydrogenase; the acyl-CoA dehydrogenases, involved in fatty acid oxidation and metabolism of branched chain amino acids; the alcohol dehydrogenases, involved in the detoxification of alcohol in the liver; and a number of glycolitic enzymes, such as lactate dehydrogenase (for a review, see Jeffery (1980) *Experientia Suppl* 36:85-125).

One particular class of dehydrogenases, the acyl-CoA dehydrogenases, are the enzymes that catalyze the alpha, beta-dehydrogenation of acyl-CoA esters and reduce an electron-transferring flavoproteins. See, e.g., Tanaka et al. (1987) *Enzyme* 38: 91-107. They catalyze the first step of the beta-oxidation cycles for fatty acids, which is a critical source of energy for the cell. Currently, five eukaryotic isozymes are known, acting on fatty acids with various chain lengths. These are short-(SCAD), medium-(MCAD), long-(LCAD), very-long-(VLCAD), and short/branched-(SBCAD) chain acyl-CoA dehydrogenases. These enzymes are located in the mitochondrion. They are all homotetrameric proteins of about 400 amino acid residues, except VLCAD which is a dimer and which contains, in its mature form, about 600 amino acid residues. See, e.g., Tanaka et al. (1987) *Enzyme* 38: 91-107; and Matsubara et al. (1989) *J. Biol. Chem.* 264: 16321-16331.

The acyl-CoA dehydrogenase family comprises a number of related enzymes that share high structural homology and a common catalytic mechanism which involves abstraction of an I-proton from the substrate (Thorpe and Kim (1995) *FASEB J* 9: 718-25). For example, acyl-CoA dehydrogenases catalyze the conversion of a fatty acyl thioester substrate to the corresponding I, θ-enoyl-CoA product. Thus, this family includes enzymes critical for the proper function of many physiological systems, including fatty acid oxidation, amino acid metabolism, and cellular proliferation and differentiation.

A 32229 polypeptide can include an "acyl-CoA dehydrogenase domain" or regions homologous with an "acyl-CoA dehydrogenase domain."

As used herein, the term "acyl-CoA dehydrogenase domain" includes an amino acid sequence of about 50 to 500 amino acid residues in length, more preferably about 100 to 400 amino acid residues, or about 200 to 300 amino acids and has a bit score for the alignment of the sequence to the acyl-CoA dehydrogenase domain (HMM) of at least 5 or greater. Preferably, the domain includes a catalytic residue providing a catalytic function to the active site, for example, an aspartate (D), at about amino acid 778 of SEQ ID NO:121. The acyl-CoA dehydrogenase domain (HMM) has been assigned the PFAM Accession Number PF00441.

In a preferred embodiment 32229 polypeptide or protein has an "acyl-CoA dehydrogenase domain" or a region which includes at least about 50 to 500, more preferably about 100 to 400, or 200 to 300 amino acid residues and has at least about 60%, 70% 80% 90% 95%, 99%, or 100% homology with an "acyl-CoA dehydrogenase," e.g., the acyl-CoA dehydrogenase domain of human 32229 (e.g., residues 502 to 529, 531 to 610, 624 to 638, and 642 to 793 of SEQ ID NO:121).

To identify the presence of an "acyl-CoA dehydrogenase" domain in a 32229 protein sequence, and make the determination that a polypeptide or protein of interest has a particular profile, the amino acid sequence of the protein can be searched against a database of HMMs (e.g., the Pfam database, release 2.1) using the default parameters. For example, the hmmsf program, which is available as part of the HMMER package of search programs, is a family specific default program for MILPAT0063 and a score of 15 is the default threshold score for determining a hit. Alternatively, the threshold score for determining a hit can be lowered (e.g., to 8 bits). A description of the Pfam database can be found in Sonhammer et al. (1997) *Proteins* 28(3): 405-420 and a detailed description of HMMs can be found, for example, in Gribskov et al. (1990) *Meth. Enzymol.* 183: 146-159; Gribskov et al. (1987) *Proc. Natl. Acad. Sci. USA* 84: 4355-4358; Krogh et al. (1994) *J. Mol. Biol.* 235: 1501-1531; and Stultz et al. (1993) *Protein Sci.* 2: 305-314, the contents of which are incorporated herein by reference. A search was performed against the HMM database resulting in the identification of "acyl-CoA dehydrogenase" domains in the amino acid sequence of human 32229 at about residues 502 to 529, 531 to 610, 624 to 638, and 642 to 793 of SEQ ID NO:121 (the identified Pfam "acyl-CoA dehydrogenase" domain consensus amino acid sequences of human 32229 correspond to SEQ ID NO:123, 124, 125 and 126).

A 32229 polypeptide can include an "acyl-CoA dehydrogenase domain" or regions homologous with an "acyl-CoA dehydrogenase domain." A 32229 polypeptide can optionally further include at least one N-glycosylation site; at least one, two, three, four, preferably five protein kinase C phosphorylation sites; at least one, two, three, four, five, six, seven, preferably eight, casein kinase II phosphorylation sites; at least one, preferably two, tyrosine kinase phosphorylation sites; at least one, two, three, four, five, six, seven, eight, preferably nine, N-myristylation sites; at least one tyrosine protein kinase specific active site signature; and at least one eukaryotic thiol (cysteine) protease histidine active site.

A 32229 polypeptide of the invention includes fragments which include: all or part of a hydrophobic sequence, e.g., the sequence from about amino acid 285 to 295 of SEQ ID NO:121; all or part of a hydrophilic sequence, e.g., the sequence from about amino acid 145 to 170 of SEQ ID NO:121; a sequence which includes a Cys, or a glycosylation site.

Based on the above-described sequence similarities, the 32229 molecules of the present invention are predicted to have similar biological activities as acyl-CoA dehydrogenase family members. For example, the 32229 protein of the present invention is predicted to have one or more of the following activities: (1) catalyzes the transfer of hydrogen and electrons from one compound to another; (2) catalyzes the I,θ-dehydrogenation of fatty acyl-CoA derivatives; (3) catalyzes the dehydrogenation of branched short-chain acyl-CoAs in the metabolism of the branched-chain amino acids; (4) oxidation of fatty acids; or (5) metabolism of amino acids. As a result, the 32229 protein may have a critical function in one or more of the following physiological processes: (1) fatty acid metabolism; (2) amino acid metabolism; (3) modulate (stimulate or inhibit) cell proliferation and differentiation; or (4) modulate tumorigenesis and tumor invasion.

As the 32229 polypeptides of the invention may modulate 32229-mediated activities, they may be useful as of for developing novel diagnostic and therapeutic agents for 32229-mediated or related disorders, as described below.

As used herein, a "32229 activity", "biological activity of 32229" or "functional activity of 32229," refers to an activity exerted by a 32229 protein, polypeptide or nucleic acid molecule. For example, a 32229 activity can be an activity exerted by 32229 in a physiological milieu on, e.g., a 32229-responsive cell or on a 32229 substrate, e.g., a protein substrate. A 32229 activity can be determined in vivo or in vitro. In one embodiment, a 32229 activity is a direct activity, such as an association with a 32229 target molecule. A "target molecule" or "binding partner" is a molecule with which a 32229 protein binds or interacts in nature. In an exemplary embodiment, 32229 is an enzyme that metabolizes fatty acyl-CoA substrates.

A 32229 activity can also be an indirect activity, e.g., a cellular signaling activity mediated by interaction of the 32229 protein with a 32229 receptor. The features of the 32229 molecules of the present invention can provide similar biological activities as acyl-CoA dehydrogenase family members.

In normal tissues, 32229 mRNA is highly expressed in the central nervous system, e.g., glial cells and brain cortex, (Congestive Heart Failure (CHF)) heart, and kidney, followed by colon tumor, liver fibrosis, prostate, DRG, coronary, and ovary (Table 31). Expression of 32229 mRNA was observed to inversely correlate with p53 expression in Lung Adenosquamous Carcinoma Cell Lines—NCI-H125 lung tumor cell lines, detected using TaqMan® analysis. Thus, the downregulation of 32229 mRNA expression in cells expressing the tumor suppressor p53 gene suggests a role for the 32229 gene in modulating the activity of aberrant cellular proliferative and differentiative cells.

32229 mRNA was also observed highly expressed in cancerous cells and tissues. TaqMan® experiments demonstrated elevated expression levels of 32229 mRNA in Poorly Differentiated Non-Small Cell Carcinoma of the Lung (PDN-SCCL), Adenocarcinoma (AC), and Smooth Muscle Carcinoma (5 mC) tissue samples. Additionally, further TaqMan® experiments showed enhanced expression of 32229 RNA in colon tumor tissues relative to normal colon tissues. Slight increases in expression in breast and ovarian tumor samples were observed. In situ hybridization showed expression of the 32229 gene in tumor 2/5 lung tumor samples, 1/2 colon tumor samples, and 2/2 breast tumor samples (Table 32). No expression of 32229 is observed in any of the normal samples.

Based upon the expression pattern of 32229 mRNA and its regulated expression in tumor cells, overexpression of 32229 may be linked to the increased energy requirements for rapidly growing and dividing tumor cells. Inhibition of this acyl-CoA dehydrogenase may inhibit tumor growth. Accordingly, the 32229 molecules can serve as novel diagnostic targets and therapeutic agents for controlling disorders involving the cells or tissues where they are expressed. For example, the 32229 molecules can serve as novel diagnostic targets and therapeutic agents for controlling disorders of cell proliferation and cell differentiation.

Examples of cellular proliferative and/or differentiative disorders include cancer, e.g., carcinoma, sarcoma, or metastatic disorders. The 32229 molecules can act as novel diagnostic targets and therapeutic agents for controlling breast cancer, ovarian cancer, colon cancer, lung cancer, metastasis of such cancers and the like, in particular, for colon cancer or lung cancer. A metastatic tumor can arise from a multitude of primary tumor types, including but not limited to those of breast, lung, liver, colon and ovarian origin.

The polypeptides and nucleic acids of the invention can also be used to treat, prevent, and/or diagnose cancers and neoplastic conditions in addition to the ones described above.

Examples of cancers or neoplastic conditions, in addition to the ones described above, include, but are not limited to, a fibrosarcoma, myosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, Ewing's tumor, leiomyosarcoma, rhabdomyosarcoma, gastric cancer, esophageal cancer, rectal cancer, pancreatic cancer, ovarian cancer, prostate cancer, uterine cancer, cancer of the head and neck, skin cancer, brain cancer, squamous cell carcinoma, sebaceous gland carcinoma, papillary carcinoma, papillary adenocarcinoma, cystadenocarcinoma, medullary carcinoma, bronchogenic carcinoma, renal cell carcinoma, hepatoma, bile duct carcinoma, choriocarcinoma, seminoma, embryonal carcinoma, Wilm's tumor, cervical cancer, testicular cancer, small cell lung carcinoma, non-small cell lung carcinoma, bladder carcinoma, epithelial carcinoma, glioma, astrocytoma, medulloblastoma, craniopharyngioma, ependymoma, pinealoma, hemangioblastoma, acoustic neuroma, oligodendroglioma, meningioma, melanoma, neuroblastoma, retinoblastoma, leukemia, lymphoma, or Kaposi sarcoma.

Examples of cellular proliferative and/or differentiative disorders of the lung include, but are not limited to, bronchogenic carcinoma, including paraneoplastic syndromes, bronchioloalveolar carcinoma, neuroendocrine tumors, such as bronchial carcinoid, miscellaneous tumors, and metastatic tumors; pathologies of the pleura, including inflammatory pleural effusions, noninflammatory pleural effusions, pneumothorax, and pleural tumors, including solitary fibrous tumors (pleural fibroma) and malignant mesothelioma.

Examples of cellular proliferative and/or differentiative disorders of the colon include, but are not limited to, non-neoplastic polyps, adenomas, familial syndromes, colorectal carcinogenesis, colorectal carcinoma, and carcinoid tumors.

Examples of cellular proliferative and/or differentiative disorders of the liver include, but are not limited to, nodular hyperplasias, adenomas, and malignant tumors, including primary carcinoma of the liver and metastatic tumors.

Examples of cellular proliferative and/or differentiative disorders of the breast include, but are not limited to, proliferative breast disease including, e.g., epithelial hyperplasia, sclerosing adenosis, and small duct papillomas; tumors, e.g., stromal tumors such as fibroadenoma, phyllodes tumor, and sarcomas, and epithelial tumors such as large duct papilloma; carcinoma of the breast including in situ (noninvasive) carcinoma that includes ductal carcinoma in situ (including Paget's disease) and lobular carcinoma in situ, and invasive (infiltrating) carcinoma including, but not limited to, invasive ductal carcinoma, invasive lobular carcinoma, medullary carcinoma, colloid (mucinous) carcinoma, tubular carcinoma, and invasive papillary carcinoma, and miscellaneous malignant neoplasms. Disorders in the male breast include, but are not limited to, gynecomastia and carcinoma.

Examples of cellular proliferative and/or differentiative disorders of the ovary include, but are not limited to, ovarian tumors such as, tumors of coelomic epithelium, serous tumors, mucinous tumors, endometeriod tumors, clear cell adenocarcinoma, cystadenofibroma, brenner tumor, surface epithelial tumors; germ cell tumors such as mature (benign) teratomas, monodermal teratomas, immature malignant teratomas, dysgerminoma, endodermal sinus tumor, choriocarcinoma; sex cord-stomal tumors such as, granulosa-theca cell tumors, thecoma-fibromas, androblastomas, hill cell tumors, and gonadoblastoma; and metastatic tumors such as Krukenberg tumors.

Identification and Characterization of Human 32229 cDNA

The human 32229 nucleic acid sequence is recited as follows:

(SEQ ID NO: 120)
TCGACCCACGCGTCCGCAGGGTTTTGCCGTGTTGCCCAAGCTGGTGTCGA

ACTCCTGGGCTCAAGCGATCTACCCACCTTACCCTCCCAAAGTGGTGAGA

TTACAGGTGTGAGCCACCATGCCTGGCTTCTATTCTTCTATGTTTGGGTT

TTCATCGTCGAGCTGATGGGCCTGTAGGGTTAATGACCCAGAGACTGCAG

TAAAGGAATTAGAAGCTCTCTTGGGTTTTACATTGAGAGTAGGTGTTCCA

AACACTCGGCCTGTGAAAAAGACGATGGAAATTCCGAAAGATTCCTTGCA

GAAGTACCTCAAAGACTTACTGGGTATCCAGACCACAGGCCCATTGGAAC

TACTTCAGTTTGATCACGGGCAGTCAAATCCAACTTACTACATCAGGCTG

GCTAATCGTGATCTAGTTCTGAGGAAGAAGCCCCCAGGGACACTCCTTCC

ATCTGCCCATGCCATAGAGAGGGAGTTCAGGATTATGAAAGCCCTTGCAA

ATGCTGGAGTACCTGTCCCTAACGTTCTTGATCTCTGTGAAGATTCAAGT

GTCATTGGCACCCCTTCTATGTGATGGAGTACTGCCCAGGTCTCATCTA

CAAAGACCCTTCCCTGCCAGGCTTGGAGCCCAGCCACAGACGAGCCATAT

ACACTGCCATGAACACAGTCCTGTGCAAAATTCACAGTGTGGATCTGCAG

GCTGTGGGACTTGAAGACTATGGGAAGCAAGGGGACTATATTCCACGCCA

GGTACGAACCTGGGTTAAGCAGTATCGAGCTTCCGAAACTAGCACCATCC

CAGCCATGGAGAGGCTGATCGAATGGCTGCCCCTCCATCTTCCCCGTCAG

CAGAGGACCACAGTGGTGCACGGGGACTTCAGGCTCGACAACCTGGTGTT

TCATCCAGAAGAGCCAGAGGTGCTTGCTGTCCTTGACTGGGAACTTTCTA

CCTTGGGCGACCCCCTTGCTGATGTGGCCTACAGCTGCCTGGCTCATTAC

CTGCCATCCAGTTTTCCCGTGCTGAGAGGTATTAATGACTGTGACTTGAC

ACAGCTGGGAATCCCTGCTGCAGAGGAGTATTTCAGGATGTACTGTCTCC

AAATGGGGCTCCCTCCCACTGAGAACTGGAACTTCTATATGGCTTTTTCC

TTTTTCCGTGTGGCTGCAATCCTACAGGGAGTCTACAAGCGATCACTCAC

AGGGCAAGCAAGCTCCACATATGCGGAACAAACTGGAAAGCTGACCGAAT

TTGTGTCTAACCTGGCGTGGGATTTCGCAGTCAAAGAAGGGTTCCGGGTT

TTCAAAGAGATGCCCTTCACAAATCCGTTAACAAGGTCCTACCACACGTG

GGCCAGGCCCCAGTCCCAGTGGTGCCCCACAGGCAGCAGGAGTTATAGCT

CCGTTCCAGAAGCTTCCCCAGCTCATACCTCAAGGGGAGGTCTGGTTATC

TCTCCAGAGAGCCTCTCTCCACCTGTCAGAGAGCTGTATCACCGGCTGAA

GCACTTCATGGAGCAACGTGTGTACCCTGCAGAGCCAGAGCTGCAGAGTC

ACCAGGCCTCAGCAGCCAGGTGGAGCCCCTCCCCACTGATCGAAGACCTC

AAGGAGAAAGCCAAAGCTGAAGGACTTTGGAACCTTTTCCTACCCTTAGA

GGCTGATCCCGAGAAAAAATACGGAGCAGGACTGACCAATGTGGAATATG

CACATCTGTGTGAGCTCATGGGCACGTCCCTGTATGCCCCCGAGGTATGT

AACTGCTCTGCGCCTGACACGGGCAACATGGAGCTGCTGGTGAGGTATGG

CACCGAAGCGCAGAAGGCTCGCTGGCTGATTCCTCTGCTGGAGGGGAAAG

CCCGCTCCTGTTTTGCTATGACCGAGCCCCAGGTTGCCTCTTCAGATGCC

-continued

```
ACCAACATTGAGGCTTCCATCAGAGAGGAGGACAGCTTCTATGTCATAAA

CGGTCACAAATGGTGGATCACAGGCATCCTGGATCCTCGTTGCCAACTCT

GTGTGTTTATGGGAAAAACAGACCCACATGCACCAAGACACCGGCAGCAG

TCTGTGCTCTTGGTTCCCATGGATACCCCAGGGATAAAAATCATCCGGCC

TCTGACGGTGTATGGACTGGAAGATGCACCAGGTGGCCATGGTGAAGTCC

GATTTGAGCACGTGCGTGTGCCCAAAGAGAACATGGTCCTGGGCCCTGGC

CGAGGCTTTGAGATCGCCCAGGGCAGACTGGGCCCCGGCAGGATCCATCA

CTGCATGAGGCTGATCGGGTTCTCAGAGAGGGCCCTGGCACTCATGAAGG

CCCGCGTGAAGTCCCGCTTGGCTTTTGGGAAGCCCCTGGTGGAGCAGGGC

ACAGTGCTGGCGGACATCGCGCAGTCGCGCGTGGAGATTGAGCAGGCACG

GCTGCTGGTGCTGAGAGCTGCCCACCTCATGGACCTGGCAGGAAACAAGG

CTGCAGCCTTGGATATAGCCATGATTAAAATGGTCGCCCCGTCCATGGCC

TCCCGAGTGATTGATCGTGCGATTCAGGCCTTTGGAGCAGCAGGCCTGAG

CAGCGACTACCCACTGGCTCAGTTCTTCACCTGGGCCCGAGCCCTGCGCT

TTGCCGACGGCCCTGACGAGGTGCACCGGGCCACGGTGGCCAAGCTAGAG

CTGAAGCACCGCATTTAGAGCCTTGGGGCTGCAGTGGCTCAATGTCCTGG

CTGGTCCAGCTGTGCCCAGATCTGTCACTGATGTGCCTCGAAAGATCCGG

TGTTTGTGGCTCCTGCACCCTGCTCAGCAGCTCTGTCCCGGGACAGTCAG

GGTGGACTCAATCTTTCTGGTTCTCCACAGAAGACGTCTCTGCAAGAAGC

CTGGAGTCTGTTTCAGGCCAGGAGGAGGGGATTTGCTGAGGGCCAAGGGG

GTTCTGGGACAGAGTCTGGAAAGCTGGTCTTCAGGCTCTCAGTCCCAGGC

TGGGCAGGCACGGTCACTTCACTTCAGCCTTTCAGTCCCTCTCTCTCTGC

CTGTGGGAATCTGGACACATTTTGGGAGGCCTCCCAAGGCTGTGGGACGT

GCTTGCTCTGGCAGCTGCAGGGTTCCTGTCTGGCCTCCCTGGTGAGCAGA

GGGGCGGCCACGGCGGGCGGTGGCCTAGAGACCCAGGACCTGGGCGCCTG

GGAAAATGGAATGCAACCCACATTGTAAAGCCACTGGCATCTGATTATCT

CCATTTGAACACACAGCACAGAACAATCATTTAAATGTTATTTTGGAAAG

GGGTTTTGGGGACACAGAAGAATAAGTAAACACAAAAAAAAAAAAAAAA

A.
```

The human 32229 sequence (SEQ ID NO:120), which is approximately 3300 nucleotides long. The nucleic acid sequence includes an initiation codon (ATG) and a termination codon (TAA) which are underscored above. The region between and inclusive of the initiation codon and the termination codon is a methionine-initiated coding sequence of about 2394 nucleotides, including the termination codon (nucleotides indicated as "coding" of SEQ ID NO:120; SEQ ID NO:122). The coding sequence encodes a 797 amino acid protein (SEQ ID NO:121), which is recited as follows:

```
                                        (SEQ ID NO: 121)
MEIPKDSLQKYLKDLLGIQTTGPLELLQFDHGQSNPTYYIRLANRDLVLR

KKPPGTLLPSAHAIEREFRIMKALANAGVPVPNVLDLCEDSSVIGTPFYV

MEYCPGLIYKDPSLPGLEPSHRRAIYTAMNTVLCKIHSVDLQAVGLEDYG

KQGDYIPRQVRTWVKQYRASETSTIPAMERLIEWLPLHLPRQQRTTVVHG

DFRLDNLVFHPEEPEVLAVLDWELSTLGDPLADVAYSCLAHYLPSSFPVL

RGINDCDLTQLGIPAAEEYFRMYCLQMGLPPTENWNFYMAFSFFRVAAIL

QGVYKRSLTGQASSTYAEQTGKLTEFVSNLAWDFAVKEGFRVFKEMPFTN

PLTRSYHTWARPQSQWCPTGSRSYSSVPEASPAHTSRGGLVISPESLSPP

VRELYHRLKHFMEQRVYPAEPELQSHQASAARWSPSPLIEDLKEKAKAEG

LWNLFLPLEADPEKKYGAGLTNVEYAHLCELMGTSLYAPEVCNCSAPDTG

NMELLVRYGTEAQKARWLIPLLEGKARSCFAMTEPQVASSDATNIEASIR

EEDSFYVINGHKWWITGILDPRCQLCVFMGKTDPHAPRHRQQSVLLVPMD

TPGIKIIRPLTVYGLEDAPGGHGEVRFEHVRVPKENMVLGPGRGFEIAQG

RLGPGRIHHCMRLIGFSERALALMKARVKSRLAFGKPLVEQGTVLADIAQ

SRVEIEQARLLVLRAAHLMDLAGNKAAALDIAMIKMVAPSMASRVIDRAI

QAFGAAGLSSDYPLAQFFTWARALRFADGPDEVHRATVAKLELKHRI.
```

Tissue Distribution of 32229 mRNA by TagMan® Analysis

Endogenous human 32229 gene expression was determined using the Perkin-Elmer/ABI 7700 Sequence Detection System which employs TaqMan® technology. Briefly, TaqMan® technology relies on standard RT-PCR with the addition of a third gene-specific oligonucleotide (referred to as a probe) which has a fluorescent dye coupled to its 5' end (typically 6-FAM) and a quenching dye at the 3' end (typically TAMRA). When the fluorescently tagged oligonucleotide is intact, the fluorescent signal from the 5' dye is quenched. As PCR proceeds, the 5' to 3' nucleolytic activity of Taq polymerase digests the labeled primer, producing a free nucleotide labeled with 6-FAM, which is now detected as a fluorescent signal. The PCR cycle where fluorescence is first released and detected is directly proportional to the starting amount of the gene of interest in the test sample, thus providing a quantitative measure of the initial template concentration. Samples can be internally controlled by the addition of a second set of primers/probe specific for a housekeeping gene such as GAPDH which has been labeled with a different fluorophore on the 5' end (typically VIC).

To determine the level of 32229 in various human tissues a primer/probe set was designed. Total RNA was prepared from a series of human tissues using an RNeasy kit from Qiagen. First strand cDNA was prepared from 1 µg total RNA using an oligo-dT primer and Superscript II reverse transcriptase (Gibco/BRL). cDNA obtained from approximately 50 ng total RNA was used per TaqMan® reaction. Tissues tested include the human tissues shown in Tables 31-32. Table 31 shows the expression of 32229 mRNA in a panel of normal human tissues, including breast, heart, blood vessels (aorta, veins), ovary, prostate, kidney, spleen, lymph nodes, colon, liver, skin, brain, brain cortex, muscle, dorsal root ganglion (DRG), glial cells (astrocytes), pancreas, and lung, and tumor tissues, including glioblastoma, breast, ovary, prostate, colon, and lung. As shown in Table 31, the highest levels of expression of 32229 were found in glial cells, brain cortex, heart, and kidney, followed by colon tumor, liver fibrosis, prostate, DRG, coronary, and ovary. As shown in Table 32, expression of 32229 mRNA was observed in tumor samples, such as tumor cell specific expression in 2/5 lung tumor samples, 1/2 colon samples, and 2/2 breast tumor samples. No significant expression of 32229 mRNA was observed in any of the normal samples. Expression values in Table 32 may have been at or below the sensitivity threshold of TaqMan® analysis (see the expression values shown in Table 31).

TABLE 31

Ct and expression values for 32229 mRNA Phase I TaqMan ® analysis.

| Tissue Type | Mean | β 2 Mean | ∂∂ Ct | Expression |
|---|---|---|---|---|
| Artery normal | 40 | 23.17 | 16.83 | 0 |
| Vein normal | 40 | 20.86 | 19.15 | 0 |
| Aortic SMC EARLY | 33.28 | 20.67 | 12.61 | 0.16 |
| Coronary SMC | 31.48 | 22.72 | 8.77 | 2.2907 |
| Static HUVEC | 32.83 | 21.02 | 11.81 | 0.2785 |
| Shear HUVEC | 35.35 | 21.4 | 13.96 | 0 |
| Heart normal | 34.7 | 19.41 | 15.3 | 0.0249 |
| Heart CHF | 26.91 | 20 | 6.92 | 8.258 |
| Kidney | 28.43 | 21.21 | 7.21 | 6.7308 |
| Skeletal Muscle | 33.82 | 22.17 | 11.65 | 0.3112 |
| Adipose normal | 36.41 | 20.2 | 16.21 | 0 |
| Pancreas | 31.28 | 22.47 | 8.81 | 2.2203 |
| primary osteoblasts | 34.81 | 19.95 | 14.87 | 0.0335 |
| Osteoclasts (diff) | 39.23 | 18.26 | 20.97 | 0 |
| Skin normal | 37.23 | 21.63 | 15.6 | 0 |
| Spinal cord normal | 36.7 | 20.68 | 16.01 | 0 |
| Brain Cortex normal | 27.7 | 21.77 | 5.93 | 16.4018 |
| Brain Hypothalamus normal | 32.95 | 22.16 | 10.79 | 0.5667 |
| Nerve | 39.7 | 25.02 | 14.69 | 0 |
| DRG (Dorsal Root Ganglion) | 31.09 | 22.78 | 8.31 | 3.1509 |
| Glial Cells (Astrocytes) | 28.72 | 22.93 | 5.79 | 18.136 |
| Glioblastoma | 29.75 | 19 | 10.76 | 0.5767 |
| Breast normal | 35.02 | 21.19 | 13.83 | 0 |
| Breast tumor | 30.7 | 18.89 | 11.81 | 0.2795 |
| Ovary normal | 30.07 | 20.88 | 9.2 | 1.7062 |
| Ovary Tumor | 39.95 | 20.84 | 19.11 | 0 |
| Prostate Normal | 32.62 | 20.02 | 12.6 | 0.1611 |
| Prostate Tumor | 31.27 | 18.68 | 12.6 | 0.1616 |
| Epithelial Cells (Prostate) | 30.68 | 22.22 | 8.46 | 2.83 |
| Colon normal | 31.36 | 18.61 | 12.75 | 0.1452 |
| Colon Tumor | 27.73 | 19.59 | 8.13 | 3.5697 |
| Lung normal | 40 | 19.55 | 20.45 | 0 |
| Lung tumor | 30.89 | 19.25 | 11.64 | 0.3144 |
| Lung COPD | 34.47 | 19.64 | 14.83 | 0.0343 |
| Colon IBD | 37.02 | 18.91 | 18.11 | 0 |
| Liver normal | 31.81 | 20.95 | 10.85 | 0.5418 |
| Liver fibrosis | 31.38 | 22.95 | 8.42 | 2.9196 |
| Spleen normal | 38.67 | 20.58 | 18.09 | 0 |
| Tonsil normal | 31.82 | 18.13 | 13.69 | 0.0757 |
| Lymph node | 34.89 | 19.62 | 15.27 | 0.0253 |
| Small intestine | 35.48 | 20.41 | 15.06 | 0 |
| Skin-Decubitus | 37.59 | 21.45 | 16.14 | 0 |
| Synovium | 40 | 21.3 | 18.7 | 0 |
| BM-MNC (Bone marrow mononuclear cells) | 34.16 | 17.71 | 16.45 | 0.0112 |
| Activated PBMC | 38.56 | 17.07 | 21.49 | 0 |
| Dermal Cells-fibroblasts | 35.81 | 30.12 | 5.68 | 19.4377 |

TABLE 32

Expression analysis of 32229 mRNA in normal and tumor samples

| Specturm # | Tissue | Diagnosis | Results |
|---|---|---|---|
| LUNG: 0/1 normal; 2/5 tumors | | | |
| CHT 457 | Lung | Normal | (−) |
| CHT 547 | Lung | Tumor: MD-AC | (−) |
| CHT 800 | Lung | Tumor: PD-NSCCL [SCC] | (+/−) |
| CHT 799 | Lung | Tumor: PD-NSCCL [SCC] | (−) |
| MPI 215 | Lung | Tumor: Small Cell | (+) |
| MPI 323 | Lung | Tumor: Small Cell | (−) |
| COLON: 0/1 normal; 1/2 tumor and metastasis | | | |
| PIT 337 | Colon | Normal | (−) |
| CHT 910 | Colon | Tumor | (+/−) |
| NDR 100 | Colon | Metastasis | (−) |
| BREAST: 0/1 normal; 2/2 tumors | | | |
| PIT 35 | Breast | Normal | (−) |
| NDR 12 | Breast | Tumor: IDC | (+) |
| MDA 155 | Breast | Tumor: IDC | (+/−) |
| POSITIVE CONTROL: 1/1 Wilm's Tumor | | | |
| CHT 734 | Kidney | Tumor: Wilm's | (+) |

Tissue Distribution of 32229 mRNA by Northern Analysis

Northern blot hybridizations with various RNA samples can be performed under standard conditions and washed under stringent conditions, i.e., 0.2×SSC at 65° C. A DNA probe corresponding to all or a portion of the 32229 cDNA (SEQ ID NO:120) can be used. The DNA was radioactively labeled with $^{32}$P-dCTP using the Prime-It Kit (Stratagene, La Jolla, Calif.) according to the instructions of the supplier. Filters containing mRNA from mouse hematopoietic and endocrine tissues, and cancer cell lines (Clontech, Palo Alto, Calif.) can be probed in ExpressHyb hybridization solution (Clontech) and washed at high stringency according to manufacturer's recommendations.

Human 22325

The 22325 sequence (SEQ ID NO:127), which is approximately 2528 nucleotides long including untranslated regions, contains a predicted methionine-initiated coding sequence of about 2178 nucleotides, including the termination codon (nucleotides indicated as coding of SEQ ID NO:127; SEQ ID NO:129). The coding sequence encodes a 725 amino acid protein (SEQ ID NO:128). The 22325 protein of SEQ ID NO:128 includes an amino-terminal hydrophobic amino acid sequence, consistent with a signal sequence, of about 37 amino acids (from amino acid 1 to about amino acid 37 of SEQ ID NO:128, PSORT, Nakai and Kanehisa (1992) *Genomics* 14:897-911), which upon cleavage results in the production of a mature protein form. This mature protein form is approximately 688 amino acid residues in length (from about amino acid 38 to amino acid 725 of SEQ ID NO:128).

22325 contains the following regions or other structural features (for general information regarding PFAM identifiers, PS prefix, and PD prefix domain identification numbers, refer to Sonnhammer et al. (1997) *Protein* 28:405-420: the N-terminal region of a biotin carboxylase domain (PFAM Accession No. PF00289) located at about amino acid residues 48 to 160 of SEQ ID NO:128; the ATP binding region of a biotin carboxylase domain (PFAM Accession No. PF02786) located at about amino acid residues 163 to 376 of SEQ ID NO:128; the C-terminal region of a biotin carboxylase domain (PFAM Accession No. PF02785) located at about amino acid residues 383 to 490 of SEQ ID NO:128; a linking region (ProDomain Accession No. PD357626) located at about amino acid residues 493 to 650 of SEQ ID NO:128; a biotin carrier domain (PFAM Accession No. PF00364) located at about amino acid residues 650 to 714 of SEQ ID NO:128; a coiled coil structure (PSORT) located at about amino acids 221 to 248 of SEQ ID NO:128; a mitochondrial processing peptidase signal site (PSORT) located at about amino acid 36 of SEQ ID NO:128; a carbamoyl-phosphate synthase subdomain signature 2 (ProSite Accession No. PS00867) located at about amino acids 333 to 340 of SEQ ID NO:128; a biotin-requiring enzyme attachment site signature (ProSite Accession No. PS00188) located at about amino acids 671 to 688 of SEQ ID NO:128; sixteen protein kinase C phosphorylation sites (ProSite Accession No. PS00005) located at about amino acids 38 to 40, 45 to 47, 67 to 69, 165 to 167, 230 to 232, 252 to 254, 407 to 409, 413 to 415, 454 to 456, 499 to 501, 541 to 543, 554 to 556, 685 to 687, 688 to 690, 693 to 695, and 719 to 721 of SEQ ID NO:128; eleven casein kinase II phosphorylation sites (ProSite Accession No. PS00006) located at about amino acids 80 to 83, 220 to 223, 238 to 241, 351 to 354, 371 to 374, 414 to 417, 465 to 468, 554 to 557, 591 to 594, 641 to 644, and 688 to 691 of SEQ ID NO:128; a cAMP/cGMP-dependent protein kinase phosphorylation site (ProSite Accession No. PS00004) located at about amino acids 721 to 724 of SEQ ID NO:128; four N-glycosylation sites (ProSite Accession No. PS00001) located at about amino acids 48 to 51, 472 to 475, 546 to 549, and 552 to 555 of SEQ ID NO:128; seven N-myristoylation sites (ProSite Accession No. PS00008) located at about amino acids 161 to 166, 210 to 215, 419 to 424, 462 to 467, 482 to 487, 587 to 592, and 702 to 707 of SEQ ID NO:128; and an amidation site (ProSite Accession No. PS00009) located at about amino acids 541 to 544 of SEQ ID NO:128.

The 22325 protein contains a significant number of structural characteristics in common with members of the biotin-requiring enzyme family including a biotin carboxylase domain a biotin carrier domain, and a linker domain. The term "family" when referring to the protein and nucleic acid molecules of the invention means two or more proteins or nucleic acid molecules having a common structural domain or motif and having sufficient amino acid or nucleotide sequence homology as defined herein. Such family members can be naturally or non-naturally occurring and can be from either the same or different species. For example, a family can contain a first protein of human origin as well as other distinct proteins of human origin, or alternatively, can contain homologs of non-human origin, e.g., rat or mouse proteins. Members of a family also can have common functional characteristics.

Biotin is an essential co-factor for a major class of enzymes that are involved in lipid, amino acid, and carbohydrate metabolism (Moss et al. (1971) *Adv. Enzymol.* 35:321-442; Wood et al. (1977) *Annu. Rev. Biochem.* 46:385-413; Wood et al. (1985) *Ann. N Y Acad. Sci.* 447:1-22; Knowles (1989) *Annu. Rev. Biochem.* 58:195-221). The biotin-requiring enzymes (BREs) of aerobic organisms are either carboxylases or transcarboxylases.

The carboxylases catalyze the transfer of a carboxyl group from bicarbonate to a metabolite such as pyruvate, propionyl-CoA, acetyl-CoA, or 3-methylcrotonyl-CoA. In a first step the biotin co-factor is carboxylated in a reaction that requires ATP, $Mg^{2+}$, and bicarbonate. The carboxyl group is then subsequently transferred from the carboxybiotin intermediate to the metabolite that is specific for each BRE.

The transcarboxylases on the other hand use metabolites (e.g., oxalacetate) instead of bicarbonate to provide the initial carboxyl group. Transcarboxylases are thereby capable of coupling the decarboxylation of a first metabolite (e.g., oxalacetate to pyruvate) with the carboxylation of second metabolite (e.g., propionyl-CoA to methylmalonyl-CoA).

BREs have three functional domains: (1) the biotin carrier domain, which carries the biotin/carboxybiotin prosthetic group; (2) the biotin carboxylase domain, which catalyzes the carboxylation of biotin; and (3) the carboxyl transferase domain, which catalyzes the transfer of a carboxyl group from carboxybiotin to the metabolite specific for each BRE. While BREs from ancient organisms such as *Escherichia coli* and *Propionibacterium shennanii* are often made up of three separate subunits (one for each of the functional domains) the BREs of higher organisms are more typically heterodimeric consisting of a biotin containing subunit (that comprises the biotin carrier domain and biotin carboxylase domain) and a non-biotin containing subunit (that comprises the carboxyl transferase domain).

The biotin prosthetic group is attached to the biotin carrier domain via an amide bond between the carboxyl group of biotin and the E-amino group of a lysine residue (Moss et al., (1971) supra). The primary sequence flanking the lysine residue targeted for biotinylation is fairly well conserved in all BREs; that sequence is (Ala/Val)-Met-Lys-(Met/Ala). The ATP binding region within the biotin carboxylase domain is also fairly well conserved among ATP dependent BREs; that sequence is Gly-Gly-Gly-Gly-Lys-Gly. Probably because of differences in metabolite specificity the carboxyl transferase domains are less conserved among BREs than are the biotin carrier and biotin carboxylase domains.

BREs are a potential target for drug action and development. Accordingly, it is valuable to the field of pharmaceutical development to identify and characterize known and previously unknown BREs.

As used herein, the term "biotin-requiring enzyme" includes a protein or polypeptide which is capable of catalyzing, alone or in combination with another enzyme or subunit, the transfer of a carboxyl group between a biotin prosthetic group and an organic substrate.

Members of the biotin-requiring enzyme family of proteins are typically mitochondrial, generally multimeric, enzymes that are involved in the carboxylation of various metabolites (e.g., pyruvate, propionyl-CoA, acetyl-CoA, and 3-methylcrotonyl-CoA). Human biotin-requiring enzymes (e.g., pyruvate carboxylase, propionyl-CoA carboxylase, acetyl-CoA carboxylase, and 3-methylcrotonyl-CoA carboxylase) are typically heterodimeric and are composed of: (1) the biotin containing subunit that comprises the biotin carboxylase domain and the biotin carrier domain; and (2) the non-biotin containing subunit that comprises the carboxyl transferase domain. An alignment of the 22325 protein with the biotin containing subunit of human 3-methylcrotonyl-CoA carboxylase (SEQ ID NO:135; MCC-B; Accession No.BAA99407 in GenPept) demonstrates about 100% sequence identity between the two sequences. The nucleic acid and amino acid sequences of the non-biotin containing subunit of human 3-methylcrotonyl-CoA carboxylase (MCC-A; GenPept Accession No. BAB41121) are shown in SEQ ID NO:136 and 137.

Fragments of 22325 which include hydrophilic regions of SEQ ID NO:128 can be used to make, e.g., used as immunogens or used to characterize the specificity of an antibody, antibodies against hydrophilic regions of the 22325 protein. Similarly, fragments of 22325 which include hydrophobic regions of SEQ ID NO: 128 can be used to make an antibody against a hydrophobic region of the 22325 protein; a fragment of 22325 which includes residues about 48 to 490, about 48 to 160, about 163 to 376, or about 383 to 490 of SEQ ID NO:128 can be used to make an antibody against the biotin carboxylase domain of the 22325 protein; a fragment of 22325 which includes residues about 493 to 650 of SEQ ID NO:128 can be used to make an antibody against the linker domain of the 22325 protein; and a fragment of 22325 which includes residues about 650 to 714 or about 671 to 688 of SEQ ID NO:128 can be used to make an antibody against the biotin carrier domain of the 22325 protein.

Biotin Carboxylase Domain

A 22325 polypeptide can include a "biotin carboxylase domain" or regions homologous with a "biotin carboxylase domain". A 22325 polypeptide can further include a "biotin carrier domain" or regions homologous with a "biotin carrier domain," and at least one linking region.

As used herein, the term "biotin carboxylase domain" includes the N-terminal, ATP binding, and C-terminal regions of 22325 and includes an amino acid sequence of about 350 to 550 amino acid residues in length, more preferably about 400 to 500 amino acids, or about 425 to 475 amino acid residues. Preferably the biotin carboxylase domain mediates the carboxylation of a biotin prosthetic group.

The N-terminal region of the biotin carboxylase domain (HMM) has been assigned the PFAM Accession No. PF00289 (SEQ ID NO:130); the ATP binding region of the biotin carboxylase domain (HMM) has been assigned the PFAM Accession No. PF02786 (SEQ ID NO:131); and the C-terminal region of the biotin carboxylase domain (HMM) has been assigned the PFAM Accession No. PF02785 (SEQ ID NO:132).

The N-terminal region of the biotin carboxylase domain includes an amino acid sequence of about 70 to 150 amino acid residues in length, more preferably about 80 to 140 amino acids, or about 90 to 120 amino acid residues having a bit score for the alignment of the sequence to the N-terminal region of the biotin carboxylase domain (HMM, PF00289) of at least 140, more preferably at least 160, most preferably 180 or greater. The ATP binding region of the biotin carboxylase domain includes an amino acid sequence of about 170 to 250 amino acid residues in length, more preferably about 180 to 240 amino acids, or about 190 to 220 amino acid residues having a bit score for the alignment of the sequence to the ATP binding region of the biotin carboxylase domain (HMM, PF02786) of at least 250, more preferably at least 300, most preferably 350 or greater. The C-terminal region of the biotin carboxylase domain includes an amino acid sequence of about 70 to 150 amino acid residues in length, more preferably about 80 to 140 amino acids, or about 90 to 120 amino acid residues having a bit score for the alignment of the sequence to the C-terminal region of the biotin carboxylase domain (HMM, PF02785) of at least 120, more preferably at least 140, most preferably 160 or greater.

The biotin carboxylase domain can include a ProSite N-glycosylation site (PS00001 which has the consensus sequence: N-{P}-[ST]-{P}); a ProSite cAMP/cGMP-dependent protein kinase phosphorylation site (PS00004 which has the consensus sequence: [RK](2)-x-[ST]); a ProSite protein kinase C phosphorylation site (PS00005 which has the consensus sequence: [ST]-x-[RK]); a ProSite casein kinase II phosphorylation site (PS00006 which has the consensus sequence: [ST]-x(2)-[DE]); a ProSite N-myristoylation site (PS00008 which has the consensus sequence: G-fEDRKHP-FYW)-x(2)-[STAGCN]-{P}); a ProSite carbamoyl-phosphate synthase subdomain signature 2 sequence (PS00867 which has the consensus sequence: [LIVMF]-[LIMN]-E-[LIVMCA]-N-[PATLIVM]-[KR]-[LIVMSTAC]); or sequences homologous thereto. In the above conserved signature sequence, and other motifs or signature sequences described herein, the standard IUPAC one-letter code for the amino acids is used. Each element in the pattern is separated by a dash (-); square brackets ([ ]) indicate the particular residues that are accepted at that position; curly brackets ({ }) indicate the particular residues that are not accepted at that position; x indicates that any residue is accepted at that position; and numbers in parentheses (( )) indicate the number of residues represented by the accompanying amino acid.

The biotin carboxylase domain can further include one or more of the following amino acids that are highly conserved among biotin-requiring enzymes and are thought to play an important role in catalysis: G209, G210, G211, G212, K213, G214, M215, R216, I217, V218, C276, H282, K284, E322, E335, N337, R339, Q341, V342, E343, and R385.

In a preferred embodiment, a 22325 polypeptide or protein has a "biotin carboxylase domain" or a region which includes at least about 350 to 550 more preferably about 400 to 500 or 425 to 475 amino acid residues and has at least about 60%, 70% 80% 90% 95%, 99%, or 100% homology with a "biotin carboxylase domain," e.g., the biotin carboxylase domain of 22325 (e.g., residues 48 to 490 of SEQ ID NO:128).

To identify the presence of a "biotin carboxylase domain" in a 22325 protein sequence, and make the determination that a polypeptide or protein of interest has a particular profile, the amino acid sequence of the protein can be searched against the PFAM database of HMMs (e.g., the PFAM database, release 2.1) using the default parameters. For example, the hmmsf program, which is available as part of the HMMER package of search programs, is a family specific default program for MILPAT0063 and a score of 15 bits is the default threshold score for determining a hit. Alternatively, the threshold score for determining a hit can be lowered (e.g., to 8 bits). A description of the PFAM database can be found in Sonhammer et al. (1997) *Proteins* 28:405-420 and a detailed description of HMMs can be found, for example, in Gribskov et al. (1990) *Meth. Enzymol.* 183:146-159; Gribskov et al. (1987) *Proc. Natl. Acad. Sci. USA* 84:4355-4358; Krogh et al. (1994) *J. Mol. Biol.* 235:1501-1531; and Stultz et al. (1993) *Protein Sci.* 2:305-314, the contents of which are incorporated herein by reference.

Biotin Carrier Domain

A 22325 molecule can further include a biotin carrier domain.

As used herein, the term "biotin carrier domain" includes an amino acid sequence of about 40 to 100 amino acid residues in length and having a bit score for the alignment of the sequence to the biotin carboxylase domain (HMM) of at least 50. Preferably the biotin carrier domain provides an attachment site for a biotin prosthetic group. The biotin carrier domain (HMM) has been assigned the PFAM Accession No. PF00364 (SEQ ID NO:133).

Preferably the biotin carrier domain includes at least about 40 to 100 amino acids, more preferably about 50 to 90 amino acid residues, or about 50 to 70 amino acids and has a bit score for the alignment of the sequence to the biotin carrier domain (HMM, PF00364) of at least 50, more preferably at lest 60, most preferably 65 or greater.

The biotin carrier domain can include a ProSite protein kinase C phosphorylation site (PS00005); a ProSite casein kinase II phosphorylation site (PS00006); a ProSite N-myristoylation site (PS00008); a ProSite biotin-requiring enzyme attachment site signature sequence (PS00188 which has the consensus sequence: [GN]-[DEQTR]-x-[LIVMFY]-x(2)-[LIVM]-x-[AIV]-M-K-[LMAT]-x(3)-[LIVM]-x-[SAV]); or sequences homologous thereto.

In a preferred embodiment, a 22325 polypeptide or protein has a "biotin carrier domain" or a region which includes at least about 40 to 100 more preferably about 50 to 90 or 50 to 70 amino acid residues and has at least about 60%, 70% 80% 90% 95%, 99%, or 100% homology with a "biotin carrier domain," e.g., the biotin carrier domain of 22325 (e.g., residues 650 to 714 of SEQ ID NO:128).

To identify the presence of a "biotin carrier domain" in a 22325 protein sequence, and make the determination that a polypeptide or protein of interest has a particular profile, the amino acid sequence of the protein can be searched against the PFAM database of HMMs (e.g., the PFAM database, release 2.1) using the default parameters. For example, the hmmsf program, which is available as part of the HMMER package of search programs, is a family specific default program for MILPAT0063 and a score of 15 bits is the default threshold score for determining a hit. Alternatively, the threshold score for determining a hit can be lowered (e.g., to 8 bits).

Linker Domain

A 22325 molecule can further include a linker domain.

As used herein, the term "linker domain" includes an amino acid sequence of about 120 to 200 amino acid residues in length and having a bit score for the alignment of the sequence to the linker domain (ProDomain PD357626) of at least 250. Preferably the linker domain links the biotin carboxylase and biotin carrier domains of the 22325. The linker domain has been assigned the ProDomain Accession No. PD357626 (SEQ ID NO:134).

Preferably, the linker domain includes at least about 120 to 200 amino acids, more preferably about 140 to 180 amino acid residues, or about 150 to 170 amino acids and has a bit score for the alignment of the sequence to the linker domain (ProDomain PD357626) of at least 250, more preferably at least 270, most preferably 290 or greater.

The linker domain can include a ProSite N-glycosylation site (PS00001); a ProSite protein kinase C phosphorylation site (PS00005); a ProSite casein kinase II phosphorylation site (PS00006); a ProSite N-myristoylation site (PS00008); or sequences homologous thereto.

In a preferred embodiment, a 22325 polypeptide or protein has a "linker domain" or a region which includes at least about 120 to 200 more preferably about 140 to 180 or 150 to 170 amino acid residues and has at least about 60%, 70% 80% 90% 95%, 99%, or 100% homology with a "linker domain," e.g., the linker domain of 22325 (e.g., residues 493 to 650 of SEQ ID NO:128).

To identify the presence of a linker domain in a 22325 protein sequence, and make the determination that a polypeptide or protein of interest has a particular profile, the amino acid sequence of the protein can be searched against a database of domains, e.g., the ProDom database (Corpet et al. (1999), *Nucl. Acids Res.* 27:263-267). The ProDom protein domain database consists of an automatic compilation of homologous domains. Current versions of ProDom are built using recursive PSI-BLAST searches (Altschul et al. (1997) *Nucleic Acids Res.* 25:3389-3402; Gouzy et al. (1999) *Computers and Chemistry* 23:333-340) of the SWISS-PROT 38 and TREMBL protein databases. The database automatically generates a consensus sequence for each domain.

A 22325 family member can include at least one biotin carboxylase domain; at least one biotin carrier domain; and at least one linker domain. A 22325 family member can further include at least one coiled coil and a mitochondrial processing peptidase signal site. Furthermore, a 22325 family member can include at least one, two, three, four, five, six, seven, eight, nine, ten, eleven, twelve, thirteen, fourteen, fifteen, preferably sixteen protein kinase C phosphorylation sites (ProSite PS00005); at least one, two, three, four, five, six, seven, eight, nine, ten, and preferably eleven casein kinase II phosphorylation sites (ProSite PS00006); at least one, two, three, preferably four N-glycosylation site (ProSite PS00001); at least one cAMP/cGMP protein kinase phosphorylation site (ProSite PS00004); at least one amidation site (ProSite PS00004); and at least one, two, three, four, five, six, preferably seven N-myristoylation sites (ProSite PS00008).

A 22325 family member can colocalize with the non-biotin containing subunit of human 3-methylcrotonyl-CoA carboxylase (MCC-A; GenPept Accession No. BAB41121). The MCC-A sequence (SEQ ID NO:137) contains a methionine-initiated coding sequence of about 1692 nucleotides, including the termination codon. The coding sequence encodes a 563 amino acid protein (SEQ ID NO:136). MCC-A contains a carboxyl transferase domain (PFAM Accession No. PF01039) located at about amino acid residues 60 to 561 of SEQ ID NO:138.

As the 22325 polypeptides of the invention can modulate 22325-mediated activities, they can be useful for developing novel diagnostic and therapeutic agents for biotin-requiring enzyme-associated or other 22325-associated disorders, as described below.

As used herein, "22325 activity", "biological activity of 22325" or "functional activity of 22325", refers to an activity exerted by a 22325 protein, polypeptide or nucleic acid molecule on e.g., a 22325-responsive cell or on a 22325 substrate, e.g., a protein substrate, as determined in vivo or in vitro. In one embodiment, 22325 activity is a direct activity, such as an association with a 22325 target molecule. A "target molecule" or "binding partner" is a molecule with which a 22325 protein binds or interacts in nature. In an exemplary embodiment, 22325 is an enzyme for an organic substrate, e.g., a metabolite such as 3-methylcrotonyl-CoA.

22325 activity can also be an indirect activity, e.g., a cellular signaling activity mediated by interaction of the 22325 protein with a 22325 receptor. Based on the above-described sequence structures and similarities to molecules of known function, the 22325 molecules of the present invention can have similar biological activities as biotin-requiring enzyme family members. For example, the 22325 proteins of the present invention can have one or more of the following activities: (1) the ability to modulate metabolism; (2) the ability to bind and hydrolyze a nucleotide, e.g., adenosine triphosphate; (3) the ability to bind a co-factor, e.g., biotin or carboxybiotin; and (4) the ability to transfer a carboxyl group from an organic substrate, e.g., bicarbonate to a co-factor, e.g., biotin. In combination with the non-biotin containing subunit MCC-A, the 22325 proteins of the present invention can further have one or more of the following activities: (1) the ability to bind a metabolite, e.g., 3-methylcrotonyl-CoA; and (2) the ability to transfer a carboxyl group from a co-factor, e.g., carboxybiotin to an organic substrate, e.g., 3-methylcrotonyl-CoA.

The 22325 molecules of the invention can modulate the activities of cells in tissues where they are expressed. For example, 22325 mRNA is expressed in proliferating, migrating and elongating endothelial cells; lung, breast, and colon tumors; angiogenic tissues such as Wilms' tumors and fetal kidney; and metabolic tissues such as the kidney, heart, liver, and brain. Accordingly, the 22325 molecules of the invention can act as therapeutic or diagnostic agents for cellular proliferative, migratory and/or differentiative disorders, endothelial cell disorders, kidney disorders, breast disorders, lung disorders, colon disorders, heart disorders, brain disorders, liver disorders, disorders associated with angiogenesis, and metabolic disorders.

The 22325 molecules can be used to treat cellular proliferative, migratory and/or differentiative disorders in part because expression of 22325 mRNA is up-regulated in proliferating, migrating and elongating endothelial cells as compared to arrested endothelial cells. Examples of cellular proliferative, migratory and/or differentiative disorders include cancer, e.g., carcinoma, sarcoma, metastatic disorders or hematopoietic neoplastic disorders, e.g., leukemias. A metastatic tumor can arise from a multitude of primary tumor types, including but not limited to those of prostate, colon, lung, breast and liver origin.

As used herein, the term "cancer" (also used interchangeably with the terms, "hyperproliferative" and "neoplastic") refers to cells having the capacity for autonomous growth, i.e., an abnormal state or condition characterized by rapidly proliferating cell growth. Cancerous disease states may be categorized as pathologic, i.e., characterizing or constituting a disease state, e.g., malignant tumor growth, or may be categorized as non-pathologic, i.e., a deviation from normal but not associated with a disease state, e.g., cell proliferation associated with wound repair. The term is meant to include all types of cancerous growths or oncogenic processes, metastatic tissues or malignantly transformed cells, tissues, or organs, irrespective of histopathologic type or stage of invasiveness. The term "cancer" includes malignancies of the various organ systems, such as those affecting lung, breast, thyroid, lymphoid, gastrointestinal, and genito-urinary tract, as well as adenocarcinomas which include malignancies such as most colon cancers, renal-cell carcinoma, prostate cancer and/or testicular tumors, non-small cell carcinoma of the lung, cancer of the small intestine and cancer of the esophagus. The term "carcinoma" is art recognized and refers to malignancies of epithelial or endocrine tissues including respiratory system carcinomas, gastrointestinal system carcinomas, genitourinary system carcinomas, testicular carcinomas, breast carcinomas, prostatic carcinomas, endocrine system carcinomas, and melanomas. Exemplary carcinomas include those forming from tissue of the cervix, lung, prostate, breast, head and neck, colon and ovary. The term "carcinoma" also includes carcinosarcomas, e.g., which include malignant tumors composed of carcinomatous and sarcomatous tissues. An "adenocarcinoma" refers to a carcinoma derived from glandular tissue or in which the tumor cells form recognizable glandular structures. The term "sarcoma" is art recognized and refers to malignant tumors of mesenchymal derivation.

Thus, the 22325 molecules can act as novel diagnostic targets and therapeutic agents for controlling tumor growth, tumor angiogenesis or other biotin-requiring enzyme disorders. As used herein, "biotin-requiring enzyme disorders" are diseases or disorders whose pathogenesis is caused by, is related to, or is associated with aberrant or deficient biotin-requiring enzyme protein function or expression. Examples of such disorders, e.g., biotin-requiring enzyme-associated or other 22325-associated disorders include, but are not limited to, metabolic disorders.

The 22325 molecules can be used to treat metabolic disorders in part because aberrant or deficient function or expression of biotin-requiring enzyme family members can result in metabolic disorders. Diseases of metabolic imbalance include, but are not limited to, obesity, anorexia nervosa, cachexia, lipid disorders, and diabetes.

Gene Expression Analysis of 22325

Total RNA was prepared from various human tissues by a single step extraction method using RNA STAT-60 according to the manufacturer's instructions (TelTest, Inc). Each RNA preparation was treated with DNase I (Ambion) at 37° C. for 1 hour. DNAse I treatment was determined to be complete if the sample required at least 38 PCR amplification cycles to reach a threshold level of fluorescence using β-2 microglobulin as an internal amplicon reference. The integrity of the RNA samples following DNase I treatment was confirmed by agarose gel electrophoresis and ethidium bromide staining. After phenol extraction cDNA was prepared from the sample using the SUPERSCRIPT™ Choice System following the manufacturer's instructions (GibcoBRL). A negative control of RNA without reverse transcriptase was mock reverse transcribed for each RNA sample.

22325 expression was measured by TaqMan® quantitative PCR (Perkin Elmer Applied Biosystems) in cDNA prepared from a variety of normal and diseased (e.g., cancerous) human tissues or cell lines.

Probes were designed by PrimerExpress software (PE Biosystems) based on the sequence of the 22325 gene. Each 22325 gene probe was labeled using FAM (6-carboxyfluorescein), and the β2-microglobulin reference probe was labeled with a different fluorescent dye, VIC. The differential labeling of the target gene and internal reference gene thus enabled measurement in same well. Forward and reverse primers and the probes for both β2-microglobulin and target gene were added to the TaqMan® Universal PCR Master Mix (PE Applied Biosystems). Although the final concentration of primer and probe could vary, each was internally consistent within a given experiment. A typical experiment contained 200 nM of forward and reverse primers plus 100 nM probe for β-2 microglobulin and 600 nM forward and reverse primers plus 200 nM probe for the target gene. TaqMan matrix experiments were carried out on an ABI PRISM 7700 Sequence Detection System (PE Applied Biosystems). The thermal cycler conditions were as follows: hold for 2 min at 50° C. and 10 min at 95° C., followed by two-step PCR for 40 cycles of 95° C. for 15 sec followed by 60° C. for 1 min.

The following method was used to quantitatively calculate 22325 gene expression in the various tissues relative to β-2 microglobulin expression in the same tissue. The threshold cycle (Ct) value is defined as the cycle at which a statistically significant increase in fluorescence is detected. A lower Ct value is indicative of a higher mRNA concentration. The Ct value of the 22325 gene is normalized by subtracting the Ct value of the α-2 microglobulin gene to obtain a ΔCt value using the following formula: $\Delta Ct = Ct_{22325} - Ct_{\beta\text{-}2\ microglobulin}$ Expression is then calibrated against a cDNA sample showing a comparatively low level of expression of the 22325 gene. The ΔCt value for the calibrator sample is then subtracted from ΔCt for each tissue sample according to the following formula: $\Delta\Delta Ct = \Delta Ct_{sample} - \Delta Ct_{calibrator}$. Relative expression is then calculated using the arithmetic formula given by $2^{-\Delta\Delta Ct}$. Relative expression levels of the target 22325 gene in each of the tissues are tabulated in more detail below (see tables 33-.

The results indicate significant 22325 expression in proliferating, migrating and elongating endothelial cells; lung, breast, and colon tumors; angiogenic tissues such as Wilms' tumors and fetal kidney; and metabolic tissues such as the kidney, heart, liver, and brain.

TABLE 33

| cHU endothelial cells | |
| --- | --- |
| State | 22325 expression level |
| Proliferating | 12.72 |
| Arrested | 5.10 |

TABLE 34 cHM-L endothelial cells

| State | 22325 expression level |
|---|---|
| Proliferating | 5.63 |
| Arrested | 2.46 |

TABLE 35 cCMEC endothelial cells

| State | 22325 expression level |
|---|---|
| Proliferating | 6.20 |
| Arrested | 0.77 |

TABLE 36

Human microvascular lung endothelial cells

| State | 22325 expression level |
|---|---|
| Proliferating | 11.85 |
| Arrested | 6.18 |

TABLE 37

Human umbilical vein endothelial cells

| State | 22325 expression level |
|---|---|
| Proliferating | 15.69 |
| Arrested | 5.66 |

TABLE 38

Lung tissue

| Tissue type | 22325 expression level |
|---|---|
| Lung (Normal) | 2.66 |
| Lung (Tumorous) | 9.16 |

TABLE 39

Breast tissue

| Tissue type | 22325 expression level |
|---|---|
| Breast (Normal) | 2.66 |
| Breast (Tumorous) | 9.16 |

TABLE 40

Colon tissue

| Tissue type | 22325 expression level |
|---|---|
| Colon (Normal) | 0.60 |
| Colon (Tumorous) | 15.79 |

TABLE 41

Angiogenic tissues

| Tissue type | 22325 expression level |
|---|---|
| Hemangioma 1 | 1.08 |
| Hemangioma 2 | 1.04 |
| Skin | 2.66 |
| Renal carcinoma | 1.23 |
| Wilms' tumor 1 | 9.32 |
| Wilms' tumor 2 | 18.14 |
| Uterine adenocarcinoma | 6.48 |
| Neuroblastoma | 4.29 |
| Fetal adrenal | 5.49 |
| Fetal kidney | 19.04 |
| Cartilage | 6.41 |

TABLE 42

Metabolic tissues

| Tissue type | 22325 expression level |
|---|---|
| Kidney (Normal) | 51.47 |
| Heart (Congestive heart failure) | 21.12 |
| Heart (Normal) | 9.85 |
| Liver (Fibrosis) | 11.64 |
| Liver (Normal) | 10.60 |
| Brain Cortex (Normal) | 93.75 |
| Brain Hypothalamus (Normal) | 28.76 |

Human 46863

The present invention is based, at least in part, on the discovery of novel methyltransferase family members, referred to herein as "46863", "Tetratricopeptide Repeat Containing Methyltransferase" or "TPRM" nucleic acid and protein molecules. These novel molecules are capable of catalyzing the transfer of a methyl group to or from biological molecules (e.g., polypeptides, arginine residues, and/or S-adenosylmethionine) and, thus, play a role in or function in a variety of cellular processes, e.g., protein methylation, arginine methylation, protein transport, gene expression, intra- or intercellular signaling, and/or cellular proliferation, growth, apoptosis, differentiation, and/or migration. As shown herein, expression of the TRPM molecules of the present invention are upregulated in lung and colon tumors and in colon metastases, and are downregulated in ovary tumors. Thus, the TPRM molecules of the present invention provide novel diagnostic targets and therapeutic agents to control TPRM-associated disorders, as defined herein.

The methyltransferase family is a large superfamily of enzymes that regulate biological processes by catalyzing the transfer of methyl groups to a wide variety of endogenous and exogenous compounds, including DNA, RNA, proteins, hormones, neurotransmitters, drugs, and xenobiotics (Weinshilboum, R. M. et al. (1999) *Annu. Rev. Pharmacol. Toxicol.* 39:19-52)

Methylation of DNA can play an important role in the control of gene expression in mammalian cells. The enzyme involved in DNA methylation is DNA methyltransferase, which catalyzes the transfer of methyl group from S-adenosylmethionine to cytosine residues to form 5-methylcytosine, a modified base that is found mostly at CpG sites in the genome. The presence of methylated CpG islands in the promoter region of genes can suppress their expression. This process may be due to the presence of 5-methylcytosine, which apparently interferes with the binding of transcription factors or other DNA-binding proteins to block transcription.

In different types of tumors, aberrant or accidental methylation of CpG islands in the promoter region has been observed for many cancer-related genes, resulting in the silencing of their expression. Such genes include tumor suppressor genes, genes that suppress metastasis and angiogenesis, and genes that repair DNA (Momparler, R. L. and Bovenzi, V. (2000) *J. Cell Physiol.* 183:145-54).

Methylation of proteins is a post-translational modification which can regulate the activity and subcellular localization of numerous proteins. Methylation of proteins can play an important role in protein repair and reversal of protein aging. Proteins undergo a variety of spontaneous degradation processes, including oxidation, glycation, deamidation, isomerization, and racemization (Finch, C. E. (1990) *Longevity, Senescence, and the Genome* (Univ. of Chicago Press, Chicago); Harding, J. J. et al. (1989) *Mech. Aging Dev.* 50:7-16; Stadtman, E. R. (1990) *Biochemistry* 29:6323-6331; Stadtman, E. R. (1992) *Science* 257:1220-1224; Geiger, T. and Clarke, S. (1987) *J. Biol. Chem.* 262:785-794; Yuan, P. M. et al. (1981) *Mech. Agin. Dev.* 17:151-172; Wright, H. T. (1991) *Crit. Rev. Biochem. Mol. Biol.* 26:1-52; Visick, J. E. and Clarke, S. (1995) *Mol. Microbiol.* 16:835-845). These non-enzymatic modifications can produce functionally damaged species that reflect the action of aging at the molecular level (Stadtman (1992) supra; Martin, G. M. et al. (1996) *Nat. Genet.* 13:25-34), and methylation of these damaged proteins can play a part in the repair pathway.

Protein methylation, which uses S-adenosylmethionine as the methyl donor (Kim and Paik (1965) *J. Biol. Chem.* 240:4629-4634; Paik and Kim (1980) in *Biochemistry: A Series of Monographs* (Meister, A. ed.), vol 1, pp. 112-141, John Wiley & Sons, New York), can be classified into three major categories (Paik and Kim (1980) in *Biochemistry: A Series of Monographs* (Meister, A. ed.), vol 1, pp. 112-141, John Wiley & Sons, New York; Paik and Kim (1985) in *Enzymology of Post-translational Modification of Proteins* (Freedman, R. B. and Hawkins, H. C., eds.), vol. 2, pp. 187-228, Academic Press, London; Clarke (1985) *Annu. Rev. Biochem.* 54:479-506; Clarke et al. (1987) *Proc. Natl. Acad. Sci. USA* 85:4643-4647; Kim et al. (1990) in *Protein Methylation* (Paik, W. K. and Kim, S. eds.), pp. 97-123, CRC Press, Boca Raton, Fla.): N-methylation involving methylation of arginine, lysine, and histidine side chains; O-methylation of either the internal carboxy group of glutamate and isoaspartate residues or the C-terminal cysteine residue; and S-methylation of either cysteine or methionine residues.

Protein methylation is also known to be important in cellular stress responses (Desrosiers, R. and Tanguay, R. (1988) *J. Biol. Chem.* 263:4686-4692). Moreover, protein methyltransferases have recently been demonstrated to be important in cellular signaling events, for example, in receptor-mediated and/or differentiation-dependent signaling (Lin, W. et al. (1996) *J. Biol. Chem.* 271:15034-15044; Abramovich, C. et al. (1997) *EMBO J.* 16:260-266).

One type of protein methylation is mediated by arginine methyltransferases. One subtype of arginine methyltransferase, the type I arginine methyltransferases, catalyze the formation of monomethylarginine and asymmetric NG,NG-dimethylarginine in a variety of substrates (Tang, J. et al. (2000) *J. Biol. Chem.* 275:19866-19876), including many RNA-binding proteins (Najbauer, J. et al. (1993) *J. Biol. Chem.* 268:10501-10509), RNA-transporting proteins (Najbauer et al. (1993) supra), transcription factors (Gary, J. D. and Clarke, S. (1998) *Prog. Nucleic Acids Res. Mol. Biol.* 61:65-131; Chen, D. et al. (1999) *Science* 284:2174-2177), nuclear matrix proteins (Gary and Clarke (1998) supra), and cytokines (Sommer, A. et al. (1989) *Biochem. Biophys. Res. Commun.* 160:1267-1274). Methylation by type I arginine methyltransferases modifies the activities of transcription factors (Gary and Clarke (1998) supra), modulates the affinity of nucleic acid binding proteins for nucleic acids (Gary and Clarke (1998) supra), regulates interferon signaling pathways (Abramovich, C. et al. (1997) *EMBO J.* 16:260-266), and alters targeting of nuclear proteins (Pintucci, G. et al. (1996) *Mol. Biol. Cell* 7:1249-1258).

The term "family" when referring to the protein and nucleic acid molecules of the invention is intended to mean two or more proteins or nucleic acid molecules having a common structural domain or motif and having sufficient amino acid or nucleotide sequence homology as defined herein. Such family members can be naturally or non-naturally occurring and can be from either the same or different species. For example, a family can contain a first protein of human origin as well as other distinct proteins of human origin or alternatively, can contain homologues of non-human origin, e.g., rat or mouse proteins. Members of a family can also have common functional characteristics.

For example, in one embodiment, members of the TPRM family of proteins include at least one "tetratricopeptide repeat motif" or "TPR motif" in the protein or corresponding nucleic acid molecule. As used interchangeably herein, the terms "tetratricopeptide repeat motif" or "TPR motif" include a protein motif having at least about 16-50 amino acid residues and a bit score of at least 2.0 when compared against a TPR Hidden Markov Model (HMM), e.g., TPR Accession Number. PF01135. Preferably, a TPR domain includes a protein having an amino acid sequence of about 22-46, 26-42, 30-38, or more preferably about 34 amino acid residues, and a bit score of at least 2.5, 3.0, 3.5, 4.0, 4.5, or more preferably, 5.0-17.4. To identify the presence of a TPR motif in a TPRM protein, and make the determination that a protein of interest has a particular profile, the amino acid sequence of the protein is searched against a database of known protein motifs and/or domains (e.g., the HMM database). The TPR domain (HMM) has been assigned the PFAM Accession number PF00590 (see the PFAM website, accessible through Washington University in Saint Louis). A search was performed against the HMM database resulting in the identification of two TPR motifs in the amino acid sequence of human TPRM at about residues 67-100 and residues 101-134 of SEQ ID NO:140.

In a further embodiment, members of the TPRM family of proteins include at least one N-terminal TPR domain. As used herein, a "TPR domain" includes at least two TPR motifs that are separated by fewer than 25, 20, 15, 10, or 5 amino acid residues. Preferably, a TPR domain includes at least two tandem TPR motifs, e.g., two TPR motifs that are separated by zero amino acid residues.

Preferably a TPR domain is at least about 32-100 amino acid residues and has a "TPR domain activity," for example, the ability to mediate protein-protein interactions (e.g., TPRM-TPRM and/or TPRM-non-TPRM interactions); mediate complex formation (e.g., coordinate multiprotein complex formation); modulate TPRM enzymatic activity; modulate signal transduction; and/or modulate protein targeting and/or cellular localization of proteins. Accordingly, identifying the presence of a "TPR domain" can include isolating a fragment of a TPRM molecule (e.g., a TPRM polypeptide) and assaying for the ability of the fragment to exhibit one of the aforementioned TPR domain activities.

A description of the Pfam database can be found in Sonhammer et al. (1997) *Proteins* 28:405-420, and a detailed description of HMMs can be found, for example, in Gribskov et al. (1990) *Methods Enzymol.* 183:146-159; Gribskov et al. (1987) *Proc. Natl. Acad. Sci. USA* 84:4355-4358; Krogh et al.

(1994) *J. Mol. Biol.* 235:1501-1531; and Stultz et al. (1993) *Protein Sci.* 2:305-314, the contents of which are incorporated herein by reference.

In another embodiment, members of the family of TPRM proteins include at least one "methyltransferase I motif" or "MT I motif" in the protein or corresponding nucleic acid molecule. As used interchangeably herein, the terms "methyltransferase I motif" and "MT I motif" include motifs having the amino acid consensus sequence [V/I/L]-[L/V]-[D/E]-[V/I/]-G-[G/C]-G-[T/P]-G (SEQ ID NO:142), wherein [V/I/L], for example, signifies that the particular amino acid at the indicated position may be either V, I, or L. The first three amino acid residues of the MT I motif have been shown to be important for catalysis using mutagenesis studies in which each of these residues were mutated to alanine. An MT I motif in the proteins of the present invention has at least 1, 2, 3, 4, 5, 6, 7, or more amino acid residues matching the MT I motif consensus sequence, and may also have additional amino acid residues. Preferably, an MT I motif of the present invention has at least 8 amino acid residues matching the MT I motif consensus sequence. For example, an MT I motif was identified in the amino acid sequence of human TPRM at about residues 181-191 of SEQ ID NO:140.

Members of the TPRM family of proteins may also be identified based on the presence of a "methyltransferase II motif" or "MT II motif" in the protein or corresponding nucleic acid molecule. As used interchangeably herein, the terms "methyltransferase II motif" or "MT II motif" include motifs having the amino acid consensus sequence [P/G]-[Q/T]-[F/Y/A]-D-A-[I/V/Y]-[F/I]-[C/V/L] (SEQ ID NO:143), wherein [P/G], for example, signifies that the particular amino acid at the indicated position may be either P or G. Preferably, an MT II motif in the proteins of the present invention has at least 1 or more amino acid residues matching the MT II motif consensus sequence. For example, an MT II motif was identified in the amino acid sequence of human TPRM at about residues 249-255 of SEQ ID NO:140.

Members of the TPRM family of proteins may further be identified based on the presence of a "methyltransferase III motif" or "MT III motif" in the protein or corresponding nucleic acid molecule. As used interchangeably herein, the terms "methyltransferase III motif" or "MT III motif" include motifs having the amino acid consensus sequence L-L-[R/K]-P-G-G-[R/I/L]-[L/I]-[L/F/I/V]-[I/L] (SEQ ID NO:144), wherein [R/K], for example, signifies that the particular amino acid at the indicated position may be either R or K. Preferably, an MT III motif in the proteins of the present invention has at least 1 or more amino acid residues matching the MT III motif consensus sequence, and more preferably has at least 2 amino acid residues matching the MTIII motif consensus sequence. For example, an MT III motif was identified in the amino acid sequence of human TPRM at about residues 264-271 of SEQ ID NO:140.

In another embodiment, members of the TPRM family include at least one C-terminal "methyltransferase domain" in the protein or corresponding nucleic acid molecule. As used herein, a "methyltransferase domain" includes at least one MT I, MT II, or MT III motif, and is about 30-150, 40-140, 50-130, 60-120, 70-110, 80-100, or preferably, 91 amino acid residues. In a preferred embodiment, a methyltransferase domain includes one MT I motif, one MT II motif, and one MT III motif. In a more preferred embodiment, the MT I, MT II, and MT III motifs within the methyltransferase domain are in order from the N terminus of the methyltransferase domain to its C terminus. Furthermore, a methyltransferase domain of the TPRM family of proteins may also be identified by the number of intervening amino acid residues between the MT I and MT II motifs, or between the MT II and MT III motifs. For example, the number of amino acid residues between an MT I and an MT II motifs is about 20-90, 30-80, 40-70, 50-60, or preferably about 57 amino acid residues. The number of amino acid residues between an MT II and an MT III motif is about 0-30, 2-25, 4-20, 5-15, 6-10, or preferably about 8 amino acid residues.

Preferably a methyltransferase domain is at least about 30-150 amino acid residues and has a "methyltransferase activity," for example, the ability to interact with a TPRM substrate or target molecule (e.g., a non-TPRM protein); to convert a TPRM substrate or target molecule to a product (e.g., transfer of a methyl group to or from the substrate or target molecule); to interact with and/or transfer a methyl group to a second non-TPRM protein; to transfer a methyl group to an arginine residue; to modulate intra- or intercellular signaling and/or gene transcription (e.g., either directly or indirectly); to modulate cellular targeting and/or transport of proteins; and/or to modulate cellular proliferation, growth, apoptosis, differentiation, and/or migration. Accordingly, identifying the presence of a methyltransferase domain" can include isolating a fragment of a TPRM molecule (e.g., a TPRM polypeptide) and assaying for the ability of the fragment to exhibit one of the aforementioned TPR domain activities.

An alignment of the human TPRM amino acid sequence with the amino acid sequences of known methyltransferases can be performed using the program MegAlign, using the Clustal method with PAM250 residue weight table. An alignment of the human TPRM amino acid sequence (SEQ ID NO: 140) with the amino acid sequences of known methyltransferases, such as: mouse arginine methyltransferase (Prmt2; GenBank Accession No. AF169620; SEQ ID NO:145); human protein arginine N-methyltransferase 1-variant 1 (HRMT1L2; GenBank Accession Nos. AF222689 or AAF62895; SEQ ID NO:146); mouse protein arginine N-methyltransferase 1 (Mrmt1; GenBank Accession No. AF232716; SEQ ID NO:147); *Arabidopsis thaliana* arginine methyltransferase (pam1; GenBank Accession Nos. AL079344 or CAB45311; SEQ ID NO:148); yeast HNRNP Arginine N-Methyltransferase (Odp1; GenBank Accession No. P38074; SEQ ID NO:149); and rat Protein Arginine N-Methyltransferase 1 (GenBank Accession No. Q63009; SEQ ID NO:150) can be performed, which demonstrates the areas of conservation between members of the methyltransferase family of proteins.

Isolated proteins of the present invention, preferably TPRM proteins, have an amino acid sequence sufficiently homologous to the amino acid sequence of SEQ ID NO:140, or are encoded by a nucleotide sequence sufficiently homologous to SEQ ID NO:139 or 141. As used herein, the term "sufficiently homologous" refers to a first amino acid or nucleotide sequence which contains a sufficient or minimum number of identical or equivalent (e.g., an amino acid residue which has a similar side chain) amino acid residues or nucleotides to a second amino acid or nucleotide sequence such that the first and second amino acid or nucleotide sequences share common structural domains or motifs and/or a common functional activity. For example, amino acid or nucleotide sequences which share common structural domains having at least 50%, 55%, 60%, 65%, 70%, 75%, 80%, 85%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, 99.9% or more homology or identity across the amino acid sequences of the domains and contain at least one and preferably two structural domains or motifs, are defined herein as sufficiently homologous. Furthermore, amino acid or nucleotide sequences which share at least 50%, 55%, 60%, 65%, 70%, 75%, 80%, 85%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, 99.9% or more homology or identity and share a common functional activity are defined herein as sufficiently homologous.

In a preferred embodiment, a TPRM protein includes an N-terminal TPR domain (including at least one TPR motif), and/or a C-terminal methyltransferase domain (including at least one MT I, one MT II, and/or one MT III motif) and has an amino acid sequence at least about 50%, 55%, 60%, 65%, 70%, 75%, 80%, 85%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, 99.9% or more homologous or identical to the amino acid sequence of SEQ ID NO:140. In yet another preferred embodiment, a TPRM protein includes an N-terminal TPR domain (including at least one TPR motif), and/or a C-terminal methyltransferase domain (including at least one MT I, one MT II, and/or one MT III motif), and is encoded by a nucleic acid molecule having a nucleotide sequence which hybridizes under stringent hybridization conditions to a complement of a nucleic acid molecule comprising the nucleotide sequence of SEQ ID NO:139 or 141. In another preferred embodiment, a TPRM protein includes an N-terminal TPR domain (including at least one TPR motif), and/or a C-terminal methyltransferase domain (including at least one MT I, one MT II, and/or one MT III motif), and has a TPRM activity.

As used interchangeably herein, a "TPRM activity", "biological activity of TPRM" or "functional activity of TPRM", includes an activity exerted or mediated by a TPRM protein, polypeptide or nucleic acid molecule on a TPRM responsive cell or on a TPRM substrate, as determined in vivo or in vitro, according to standard techniques. In one embodiment, a TPRM activity is a direct activity, such as an association with a TPRM target molecule. As used herein, a "target molecule" or "binding partner" is a molecule with which a TPRM protein binds or interacts in nature, such that TPRM-mediated function is achieved. A TPRM target molecule can be a non-TPRM molecule or a TPRM protein or polypeptide of the present invention. In an exemplary embodiment, a TPRM target molecule is a TPRM substrate (e.g., a polypeptide substrate, an arginine residue, or S-adenosylmethionine). A TPRM activity can also be an indirect activity, such as a cellular signaling activity mediated by interaction of the TPRM protein with a TPRM substrate.

In a preferred embodiment, a TPRM activity is at least one of the following activities: (i) interaction with a TPRM substrate or target molecule (e.g., a non-TPRM protein); (ii) conversion of a TPRM substrate or target molecule to a product (e.g., transfer of a methyl group to or from the substrate or target molecule); (iii) interaction with and/or methyl transfer to a second non-TPRM protein; (iv) transfer of a methyl group to an arginine residue; (v) modulation of protein-protein interaction (e.g., TPRM-TPRM and/or TPRM-non-TPRM interaction); (vi) modulation and/or coordination of protein complex formation (e.g., TPRM-containing complexes); (vii) regulation of substrate or target molecule activity; (viii) modulation of intra- or intercellular signaling and/or gene transcription (e.g., either directly or indirectly); (ix) modulation of cellular targeting and/or transport of proteins; and/or (x) modulation of cellular proliferation, growth, apoptosis, differentiation, and/or migration.

Isolation of the Human 46863 (TPRM) cDNA

The invention is based, at least in part, on the discovery of genes encoding novel members of the tetratricopeptide repeat containing methyltransferase family. The entire sequence of human clone Fbh46863 was determined and found to contain an open reading frame termed human "TPRM".

The nucleotide sequence encoding the human TPRM is set forth as SEQ ID NO:139. The human TPRM gene, which is approximately 2864 nucleotides in length, encodes a protein having a molecular weight of approximately 93 kD and which is approximately 845 amino acid residues in length. The protein encoded by this nucleic acid comprises about 845 amino acids and has the amino acid sequence set forth as SEQ ID NO:140. The coding region (open reading frame) of SEQ ID NO:139 is set forth as SEQ ID NO:141.

Analysis of the Human 46863 (TPRM) Molecules

The amino acid sequence of human TPRM was analyzed using the program PSORT (available online; see Nakai, K. and Kanehisa, M. (1992) *Genomics* 14:897-911) to predict the localization of the proteins within the cell. This program assesses the presence of different targeting and localization amino acid sequences within the query sequence. The results of the analyses show that human TPRM is most likely localized to the cytoplasm, mitochondria, or nucleus.

Analysis of the amino acid sequence of human TPRM was performed using MEMSAT. This analysis resulted in the identification of a possible transmembrane domain in the amino acid sequence of human TPRM at residues 173-195 of SEQ ID NO:140. However, it is noted that the score for this predicted transmembrane domain is low (i.e., 0.4).

Searches of the amino acid sequence of human TPRM were also performed against the HMM database. These searches resulted in the identification of two "TPR motifs" at about residues 67-100 (score=5.0) and 101-134 (score=17.4) of SEQ ID NO:140.

Searches of the amino acid sequence of human TPRM were further performed against the Prosite database. These searches resulted in the identification in the amino acid sequence of human TPRM of potential N-glycosylation sites, a potential glycosaminoglycan attachment site, a potential cAMP- and cGMP-dependent protein kinase phosphorylation site, and a number of potential protein kinase C phosphorylation sites, casein kinase II phosphorylation sites, and N-myristoylation sites.

A search of the amino acid sequence of human TPRM was also performed against the ProDom database, resulting in the identification of homology between human TPRM and arginine N-methyltransferase protein interferon receptor 1-bound alternative splicing protein.

Tissue Distribution of 46863 (TPRM) mRNA Using In Situ Hybridization Analysis

This example describes the tissue distribution of human TPRM mRNA, as may be determined using in situ hybridization analysis. For in situ analysis, various tissues, e.g., tissues obtained from brain, are first frozen on dry ice. Ten-micrometer-thick sections of the tissues are postfixed with 4% formaldehyde in DEPC-treated 1× phosphate-buffered saline at room temperature for 10 minutes before being rinsed twice in DEPC 1× phosphate-buffered saline and once in 0.1 M triethanolamine-HCl (pH 8.0). Following incubation in 0.25% acetic anhydride-0.1 M triethanolamine-HCl for 10 minutes, sections are rinsed in DEPC 2×SSC (1×SSC is 0.15 M NaCl plus 0.015 M sodium citrate). Tissue is then dehydrated through a series of ethanol washes, incubated in 100% chloroform for 5 minutes, and then rinsed in 100% ethanol for 1 minute and 95% ethanol for 1 minute and allowed to air dry.

Hybridizations are performed with $^{35}$S-radiolabeled ($5\times10^7$ cpm/ml) cRNA probes. Probes are incubated in the presence of a solution containing 600 mM NaCl, 10 mM Tris (pH 7.5), 1 mM EDTA, 0.01% sheared salmon sperm DNA, 0.01% yeast tRNA, 0.05% yeast total RNA type X1, 1×Denhardt's solution, 50% formamide, 10% dextran sulfate, 100 mM dithiothreitol, 0.1% sodium dodecyl sulfate (SDS), and 0.1% sodium thiosulfate for 18 hours at 55° C.

After hybridization, slides are washed with 2×SSC. Sections are then sequentially incubated at 37° C. in TNE (a solution containing 10 mM Tris-HCl (pH 7.6), 500 mM NaCl, and 1 mM EDTA), for 10 minutes, in TNE with 10 μg of RNase A per ml for 30 minutes, and finally in TNE for 10 minutes. Slides are then rinsed with 2×SSC at room temperature, washed with 2×SSC at 50° C. for 1 hour, washed with 0.2×SSC at 55° C. for 1 hour, and 0.2×SSC at 60° C. for 1 hour. Sections are then dehydrated rapidly through serial ethanol-0.3 M sodium acetate concentrations before being air dried and exposed to Kodak Biomax MR scientific imaging film for 24 hours and subsequently dipped in NB-2 photoemulsion and exposed at 4° C. for 7 days before being developed and counter stained.

Analysis of 46863 (TPRM) mRNA Expression Using the TaqMan® Procedure

The TaqMan® procedure is a quantitative, real-time PCR-based approach to detecting mRNA. The RT-PCR reaction exploits the 5' nuclease activity of AmpliTaq Gold™ DNA Polymerase to cleave a TaqMan® probe during PCR. Briefly, cDNA was generated from the samples of interest and served as the starting material for PCR amplification. In addition to the 5' and 3' gene-specific primers, a gene-specific oligonucleotide probe (complementary to the region being amplified) was included in the reaction (i.e., the TaqMan® probe). The TaqMan® probe included an oligonucleotide with a fluorescent reporter dye covalently linked to the 5' end of the probe (such as FAM (6-carboxyfluorescein), TET (6-carboxy-4,7,2',7'-tetrachlorofluorescein), JOE (6-carboxy-4,5-dichloro-2,7-dimethoxyfluorescein), or VIC) and a quencher dye (TAMRA (6-carboxy-N,N,N',N'-tetramethylrhodamine) at the 3' end of the probe.

During the PCR reaction, cleavage of the probe separated the reporter dye and the quencher dye, resulting in increased fluorescence of the reporter. Accumulation of PCR products was detected directly by monitoring the increase in fluorescence of the reporter dye. When the probe was intact, the proximity of the reporter dye to the quencher dye resulted in suppression of the reporter fluorescence. During PCR, if the target of interest was present, the probe specifically annealed between the forward and reverse primer sites. The 5'-3' nucleolytic activity of the AmpliTaq™ Gold DNA Polymerase cleaved the probe between the reporter and the quencher only if the probe hybridized to the target. The probe fragments were then displaced from the target, and polymerization of the strand continued. The 3' end of the probe was blocked to prevent extension of the probe during PCR. This process occurred in every cycle and did not interfere with the exponential accumulation of product. RNA was prepared using the trizol method and treated with DNase to remove contaminating genomic DNA. cDNA was synthesized using standard techniques. Mock cDNA synthesis in the absence of reverse transcriptase resulted in samples with no detectable PCR amplification of the control GAPDH or β-actin gene confirming efficient removal of genomic DNA contamination.

The expression of human 46863 (TPRM) was examined in various tumorigenic cell lines using TaqMan® analysis. The results, set forth below in Table 43, indicate that human TPRM is highly expressed in MCF-7 cells, ZR75 cells, T47D cells, SKBr3 cells, DLD 1 cells, SW480 cells, SW620 cells, NCIH125 cells, NCIH67 cells, NCIH322 cells, A549 cells, NHBE cells, OVCAR-3 cells, 293 cells, and 293T cells. The cell lines analyzed in Table 44 are as follows: MCF-7, ZR75, T47D, MDA 231, MDA 435, and SKBr3 are human breast cancer cell lines; DLD 1, SW480, SW620, HCT116, HT29, and Colo 205 are human colon cancer cell lines; NCIH 125, NCIH 67, NCIH 322, NCIH 460, and A549 are human lung cancer cell lines; NHBE is a normal human bronchial epithelium cell line; SKOV-3 and OVCAR-3 are human ovarian cancer cell lines; and 293 and 293T are human embryonic kidney cell lines.

TABLE 43

| Tissue Type | 46863 Mean | β2 Mean | ∂∂ Ct | Expression |
|---|---|---|---|---|
| 1. MCF-7 Breast tumor | 25.54 | 20.25 | 5.29 | 25.56 |
| 2. ZR75 Breast tumor | 28.79 | 22.68 | 6.11 | 14.48 |
| 3. T47D Breast tumor | 27.32 | 20.87 | 6.46 | 11.40 |
| 4. MDA 231 Breast tumor | 29.04 | 20.32 | 8.72 | 2.36 |
| 5. MDA 435 Breast tumor | 28.8 | 20.24 | 8.56 | 2.65 |
| 6. SKBr3 Breast | 29.82 | 23.3 | 6.53 | 10.86 |
| 7. DLD 1 Colon tumor (stage C) | 26.21 | 22.09 | 4.13 | 57.31 |
| 8. SW480 Colon tumor (stage B) | 29.04 | 20.59 | 8.44 | 2.88 |
| 9. SW620 Colon tumor (stage C) | 26.63 | 20.39 | 6.24 | 13.23 |
| 10. HCT116 | 30.65 | 23.16 | 7.49 | 5.58 |
| 11. HT29 | 31.08 | 20.48 | 10.61 | 0.64 |
| 12. Colo 205 | 30.54 | 19.44 | 11.1 | 0.46 |
| 13. NCIH125 | 28.25 | 21.54 | 6.71 | 9.52 |
| 14. NCIH67 | 29.71 | 22.41 | 7.3 | 6.32 |
| 15. NCIH322 | 28.62 | 22.87 | 5.75 | 18.58 |
| 16. NCIH460 | 30.82 | 22.82 | 8 | 3.92 |
| 17. A549 | 31.77 | 25.14 | 6.63 | 10.10 |
| 18. NHBE | 30.19 | 24.54 | 5.66 | 19.85 |
| 19. SKOV-3 ovary | 27.22 | 19.27 | 7.95 | 4.06 |
| 20. OVCAR-3 ovary | 28.86 | 22.47 | 6.4 | 11.84 |
| 21. 293 Baby Kidney | 28.6 | 23.41 | 5.2 | 27.30 |
| 22. 293T Baby Kidney | 29.74 | 25.25 | 4.49 | 44.66 |

The expression of human 46863 (TPRM) was examined in certain synchronized tumorigenic cell lines using TaqMan® analysis. The results are set forth below in Table 44. The cell lines were induced to enter the cell cycle after synchronization with either aphidocholine, nocodazole, or mimosine. Notably, human TPRM shows cell-cycle dependent regulation (such as can be seen with known tumor suppressor proteins and/or oncogenes) in HCT 116 colon cancer cells synchronized with aphidocholine (but not nocodazole); in DLD colon cancer cells synchronized with nocodazole, and in MCF10A breast cancer cells synchronized with mimosine.

TABLE 44

| Tissue Type | 46863 Mean | B2 Mean | ∂∂ Ct | Expression |
|---|---|---|---|---|
| 1. HCT 116 Aphidl t = 0 | 26.93 | 21.45 | 5.49 | 22.25 |
| 2. HCT 116 Aphidl t = 3 | 26.66 | 21.98 | 4.68 | 39.01 |
| 3. HCT 116 Aphidl t = 6 | 26.82 | 22.05 | 4.78 | 36.52 |
| 4. HCT 116 Aphidl t = 9 | 26.75 | 22.32 | 4.43 | 46.39 |
| 5. HCT 116 Aphidl t = 12 | 26.35 | 22.09 | 4.26 | 52.19 |
| 6. HCT 116 Aphidl t = 15 | 26.98 | 21.83 | 5.14 | 28.26 |
| 7. HCT 116 Aphidl t = 18 | 27.61 | 21.68 | 5.92 | 16.52 |
| 8. HCT 116 Aphidl t = 21 | 27.18 | 22.02 | 5.16 | 27.97 |
| 9. HCT 116 Aphidl t = 24 | 27.63 | 22.61 | 5.03 | 30.71 |
| 10. HCT 116 Noc t = 0 | 28.3 | 23.27 | 5.03 | 30.71 |
| 11. HCT 116 Noc t = 3 | 28.59 | 23.43 | 5.17 | 27.87 |
| 12. HCT 116 Noc t = 6 | 27.73 | 22.66 | 5.07 | 29.87 |
| 13. HCT 116 Noc t = 9 | 27.23 | 22.03 | 5.2 | 27.30 |
| 14. HCT 116 Noc t = 15 | 28.14 | 23.23 | 4.91 | 33.38 |
| 15. HCT 116 Noc t = 21 | 28.08 | 23.11 | 4.96 | 32.02 |
| 16. HCT 116 Noc t = 24 | 28.11 | 23.93 | 4.18 | 54.98 |
| 17. DLD noc t = 3 | 27.54 | 24.34 | 3.19 | 109.20 |
| 18. DLD noc t = 9 | 27.75 | 24.95 | 2.81 | 143.09 |
| 19. DLD noc t = 12 | 27.22 | 24.98 | 2.23 | 212.42 |

TABLE 44-continued

| Tissue Type | 46863 Mean | B2 Mean | ∂∂ Ct | Expression |
|---|---|---|---|---|
| 20. DLD noc t = 15 | 28.07 | 25.2 | 2.87 | 136.79 |
| 21. DLD noc t = 18 | 27.45 | 24.95 | 2.49 | 178.01 |
| 22. DLD noc t = 21 | 27.6 | 24.54 | 3.06 | 119.91 |
| 23. A549 Mimo t = 0 | 27.37 | 22.12 | 5.25 | 26.28 |
| 24. A549 Mimo t = 3 | 26.62 | 21.95 | 4.67 | 39.15 |
| 25. A549 Mimo t = 6 | 27.82 | 22.63 | 5.18 | 27.49 |
| 26. A549 Mimo t = 9 | 26.66 | 22.04 | 4.63 | 40.53 |
| 27. A549 Mimo t = 15 | 26.5 | 21.62 | 4.88 | 34.08 |
| 28. A549 Mimo t = 18 | 26.39 | 21.49 | 4.89 | 33.61 |
| 29. A549 Mimo t = 21 | 27.25 | 21.95 | 5.29 | 25.56 |
| 30. A549 Mimo t = 24 | 26.41 | 21.93 | 4.47 | 44.97 |
| 31. MCF10A Mimo t = 0 | 28.7 | 23.81 | 4.88 | 33.84 |
| 32. MCF10A Mimo t = 3 | 29.87 | 22.58 | 7.29 | 6.39 |
| 33. MCF10A Mimo t = 6 | 27.16 | 21.39 | 5.78 | 18.26 |
| 34. MCF10A Mimo t = 9 | 28.4 | 22.98 | 5.42 | 23.28 |
| 35. MCF10A Mimo t = 12 | 28.01 | 21.98 | 6.03 | 15.30 |
| 36. MCF10A Mimo t = 18 | 28.75 | 22.23 | 6.52 | 10.90 |
| 37. MCF10A Mimo t = 21 | 29.73 | 22.36 | 7.36 | 6.09 |
| 38. MCF10A Mimo t = 24 | 29.45 | 21.95 | 7.5 | 5.54 |
| 39. HCT 116 Noc t = 18 | 26.73 | 21.35 | 5.38 | 24.10 |
| 40. DLD noc t = 0 | 29.99 | 26.54 | 3.45 | 91.51 |
| 41. DLD noc t = 6 | 26.19 | 22.68 | 3.52 | 87.47 |

The expression of human TPRM was examined in clinical human tumors using TaqMan® analysis. The results of the analysis, set forth below in Table 45 indicated that human TPRM expression is downregulated in 5/5 ovary tumors, as compared to normal ovary; upregulated in 5/6 lung tumors, as compared to normal lung; upregulated in 4/4 colon tumors, as compared to normal colon; and downregulated in HCT116 colon tumor cells subjected to hypoxic conditions.

TABLE 45

| Tissue Type | Mean | β 2 Mean | ∂∂ Ct | Expression |
|---|---|---|---|---|
| 1. Breast normal | 29.18 | 18.95 | 9.07 | 1.86 |
| 2. Breast normal | 28.81 | 19.5 | 8.16 | 3.50 |
| 3. Breast normal | 32.03 | 19.04 | 11.85 | 0.27 |
| 4. Breast tumor: PD-infiltrating ductal carcinoma (IDC) | 28.57 | 17.92 | 9.49 | 1.39 |
| 5. Breast tumor: MD-infiltrating ductal carcinoma (IDC) | 28.79 | 18.57 | 9.07 | 1.86 |
| 6. Breast tumor: infiltrating ductal carcinoma (IDC) | 28.86 | 19.72 | 7.98 | 3.96 |
| 7. Breast tumor: infiltrating ductal carcinoma (IDC) | 29.83 | 17.95 | 10.72 | 0.59 |
| 8. Breast tumor - invasive lobular carcinoma (ILC) (low grade) | 28.84 | 19.82 | 7.87 | 4.29 |
| 9. Lymph node (Breast metastasis) | 33.27 | 20.61 | 11.51 | 0.34 |
| 10. Lung (Breast metastasis) | 33.01 | 21.45 | 10.4 | 0.74 |
| 11. Ovary normal | 26.08 | 18.4 | 6.53 | 10.86 |
| 12. Ovary normal | 23.03 | 18.36 | 3.52 | 87.17 |
| 13. Ovary tumor | 29.15 | 20.72 | 7.28 | 6.46 |
| 14. Ovary tumor | 28.22 | 17.7 | 9.36 | 1.53 |
| 15. Ovary tumor | 28.04 | 18.97 | 7.92 | 4.14 |
| 16. Ovary tumor | 30.48 | 21.09 | 8.24 | 3.30 |
| 17. Ovary tumor | 28.05 | 17.52 | 9.38 | 1.51 |
| 18. Lung normal | 28.43 | 18 | 9.27 | 1.62 |
| 19. Lung normal | 30.61 | 19.23 | 10.22 | 0.84 |
| 20. Lung normal | 30.73 | 19.77 | 9.8 | 1.12 |
| 21. LungT--SmC | 27.15 | 18.19 | 7.8 | 4.47 |
| 22. Lung T-Poorly differentiated non-small cell carcinoma of the lung (PDNSCCL) | 26.53 | 18.88 | 6.5 | 11.09 |
| 23. Lung tumor - Poorly differentiated non-small cell carcinoma of the lung (PDNSCCL) | 28.05 | 17.84 | 9.05 | 1.89 |

TABLE 45-continued

| Tissue Type | Mean | β 2 Mean | ∂∂ Ct | Expression |
|---|---|---|---|---|
| 24. Lung tumor - small cell carcinoma (SCC) | 30.72 | 21.53 | 8.03 | 3.83 |
| 25. Lung tumor - adenocarcinoma (ACA) | 28.66 | 17.68 | 9.82 | 1.10 |
| 26. Lung tumor - adenocarcinoma (ACA) | 29.66 | 20.56 | 7.95 | 4.06 |
| 27. Colon normal | 28.41 | 15.88 | 11.38 | 0.38 |
| 28. Colon normal | 29.82 | 17.86 | 10.81 | 0.56 |
| 29. Colon normal | 27.61 | 14.8 | 11.66 | 0.31 |
| 30. Colon tumor: MD | 30.95 | 20.47 | 9.33 | 1.55 |
| 31. Colon tumor: MD | 26.11 | 17.03 | 7.93 | 4.10 |
| 32. Colon tumor | 28.7 | 18.16 | 9.38 | 1.50 |
| 33. Colon tumor: MD-PD | 32.29 | 22.04 | 9.1 | 1.83 |
| 34. Colon-Liver Met | 30.26 | 19.98 | 9.13 | 1.79 |
| 35. Colon-Liver Met | 31.67 | 19.57 | 10.95 | 0.51 |
| 36. Liver normal (female) | 30.5 | 17.81 | 11.53 | 0.34 |
| 37. Cervix Squamous cell carcinoma | 30.5 | 20.26 | 9.09 | 1.84 |
| 38. Cervix Squamous cell carcinoma | 31.16 | 18.22 | 11.79 | 0.28 |
| 39. A24 human microvascular endothelial cells (HMVEC) - Arrested | 28.66 | 17.75 | 9.75 | 1.16 |
| 40. C48 human microvascular endothelial cells (HMVEC) - Proliferating | 28.58 | 18.19 | 9.23 | 1.66 |
| 41. Pooled Hemangiomas | 31.41 | 18.05 | 12.21 | 0.21 |
| 42. HCT116N22 Normoxic | 28.46 | 20.48 | 6.83 | 8.79 |
| 43. HCT116H22 Hypoxic | 29.9 | 20.91 | 7.83 | 4.39 |

The expression of human TPRM was examined in clinical human colon tumors of different stages using TaqMan® analysis. The results of the analysis, set forth below in Table 46, indicated that human TPRM expression is highly expressed in colon metastases to the liver and the abdomen, as compared to normal liver and normal colon.

TABLE 46

| Tissue Type | Mean | β 2 Mean | ∂∂ Ct | Expression |
|---|---|---|---|---|
| 1. Colon normal | 27.7 | 18.47 | 9.23 | 1.67 |
| 2. Colon normal | 26.68 | 18.54 | 8.14 | 3.55 |
| 3. Colon normal | 27 | 18.41 | 8.6 | 2.58 |
| 4. Colon normal | 27.8 | 21.69 | 6.11 | 14.48 |
| 5. Colon normal | 25.96 | 18.55 | 7.42 | 5.86 |
| 6. Adenomas | 26.79 | 19.39 | 7.41 | 5.90 |
| 7. Adenomas | 27.42 | 20.78 | 6.64 | 10.03 |
| 8. Colonic adenocarcinoma - ACA-B | 25.86 | 18.48 | 7.38 | 6.00 |
| 9. Colonic adenocarcinoma - ACA-B | 25.36 | 18.28 | 7.08 | 7.42 |
| 10. Colonic adenocarcinoma - ACA-B | 25.95 | 18.12 | 7.84 | 4.38 |
| 11. Colonic adenocarcinoma - ACA-B | 30.57 | 24.32 | 6.25 | 13.18 |
| 12. Colonic adenocarcinoma - ACA-B | 28.32 | 18.16 | 10.16 | 0.87 |
| 13. Colonic adenocarcinoma - ACA-C | 24.95 | 18.25 | 6.7 | 9.62 |
| 14. Colonic adenocarcinoma - ACA-C | 28 | 19.64 | 8.37 | 3.03 |
| 15. Colonic adenocarcinoma - ACA-C | 26.41 | 18.7 | 7.71 | 4.78 |
| 16. Colonic adenocarcinoma - ACA-C | 25.8 | 18.9 | 6.9 | 8.37 |
| 17. Colonic adenocarcinoma - ACA-C | 26.11 | 19.85 | 6.26 | 13.05 |
| 18. Colonic adenocarcinoma - ACA-C | 25.77 | 18.57 | 7.2 | 6.80 |
| 19. Liver normal | 26.88 | 20.89 | 6 | 15.68 |
| 20. Liver normal | 25.23 | 19.4 | 5.83 | 17.58 |
| 21. Liver normal | 25.81 | 19.76 | 6.04 | 15.15 |

TABLE 46-continued

| Tissue Type | Mean | β 2 Mean | ∂∂ Ct | Expression |
|---|---|---|---|---|
| 22. Liver normal | 24.68 | 19.02 | 5.66 | 19.78 |
| 23. Liver normal | 25.91 | 20.23 | 5.69 | 19.37 |
| 24. Liver normal | 26.5 | 21.41 | 5.09 | 29.26 |
| 25. Colon Liver Met | 25.17 | 20.22 | 4.95 | 32.35 |
| 26. Colon Liver Met | 24.14 | 19.23 | 4.91 | 33.26 |
| 27. Colon Liver Met | 24.32 | 20.02 | 4.29 | 50.94 |
| 28. Colon Liver Met | 25.04 | 20.33 | 4.71 | 38.34 |
| 29. Colon Liver Met | 23.55 | 18.91 | 4.63 | 40.39 |
| 30. Colon Abdominal Met | 22.21 | 17.33 | 4.88 | 33.96 |
| 31. Colon normal | 33.15 | 26.82 | 6.33 | 12.43 |
| 32. Colonic adenocarcinoma - ACA-B | 34.6 | 31.28 | 3.33 | 99.79 |
| 33. Colonic adenocarcinoma - ACA-B | 31.36 | 26.44 | 4.92 | 33.15 |
| 34. Colon Liver Met | 37.41 | 34.62 | 2.79 | 145.09 |

The expression of human TPRM was examined in in vitro oncogene cell models using TaqMan® analysis. The results of the analysis, set forth below in Table 47 below, show that human TPRM is highly expressed in SW48 RER+ cells, JDLD-1 cells, JHCT116 cells, DKO1 cells, DKO4 cells, DKS-8 cells, and HK2-6 cells.

TABLE 47

| Tissue Type | 46863 Mean | B2 Mean | ∂∂ Ct | Expression |
|---|---|---|---|---|
| 1. SMAD4-SW480 C | 34.94 | 25.42 | 9.52 | 1.36 |
| 2. SMAD4-SW480 24HR | 29.7 | 21.71 | 7.99 | 3.93 |
| 3. SMAD4-SW480 48HR | 29.75 | 22.22 | 7.53 | 5.41 |
| 4. SMAD4-SW480 72HR | 30.31 | 21.5 | 8.81 | 2.23 |
| 5. L51747-MUCINOUS | 30.55 | 22.53 | 8.02 | 3.85 |
| 6. HT29 NON-MUCINOUS | 31.45 | 22.11 | 9.35 | 1.54 |
| 7. SW620 NON-MUCINOUS | 30.6 | 22.66 | 7.94 | 4.07 |
| 8. CSC-1 NORMAL | 30.72 | 22.34 | 8.38 | 3.00 |
| 9. NCM-460 NORMAL | 30.27 | 22.16 | 8.1 | 3.64 |
| 10. HCT116 RER+ | 30.91 | 22.34 | 8.57 | 2.62 |
| 11. SW48 RER+ | 30.97 | 25.54 | 5.43 | 23.12 |
| 12. SW480 RER-/- | 30.06 | 22.34 | 7.72 | 4.74 |
| 13. CACO-RER-/- | 28.95 | 21.5 | 7.46 | 5.70 |
| 14. JDLD-1 | 28.52 | 24.84 | 3.69 | 77.75 |
| 15. JHCT116 | 29.9 | 23.87 | 6.03 | 15.30 |
| 16. DKO1 | 29.29 | 24.95 | 4.33 | 49.72 |
| 17. DKO4 | 29.64 | 25.3 | 4.34 | 49.55 |
| 18. DKS-8 | 29.14 | 25.09 | 4.05 | 60.37 |
| 19. HKe3 | 30.23 | 22.33 | 7.9 | 4.19 |
| 20. HKh2 | 30.72 | 22.09 | 8.62 | 2.54 |
| 21. HK2-6 | 29.86 | 24.18 | 5.67 | 19.64 |
| 22. e3Ham#9 | 30.41 | 22.52 | 7.88 | 4.25 |
| 23. APC5 -/- | 35.45 | 23.74 | 11.71 | 0.00 |
| 24. APC6-/- | 29.56 | 20.59 | 8.96 | 2.00 |
| 25. APC1+/+ | 31.92 | 20.27 | 11.65 | 0.31 |
| 26. APC13+/+ | 34.08 | 23.4 | 10.68 | 0.61 |

Human 32252

The human 32252 sequence (see SEQ ID NO:151, as recited below in the section entitled "Identification and Characterization of Human 32252 cDNA"), which is approximately 2625 nucleotides long including untranslated regions, contains a predicted methionine-initiated coding sequence of about 2019 nucleotides, including the termination codon (nucleotides 136 to 2151 of SEQ ID NO:151; SEQ ID NO:153). The coding sequence encodes a 672 amino acid protein (see SEQ ID NO:152, as recited below in the section entitled "Identification and Characterization of Human 32252 cDNA").

Human 32252 has the structural features of an acetoacetyl-CoA enzyme. Amino acid residues 1 to 672 of SEQ ID NO:152 align with amino acid residues 1-672 of rat acetoacetyl-CoA synthetase (SEQ ID NO:154) with 89% sequence identity (600/672). The BLAST score for this alignment is 3210 (1473.7 bits). The consensus sequence between the human acetoacetyl-CoA synthetase (SEQ ID NO:152) and the rat acetoacetyl-CoA synthetase (SEQ ID NO:154) is given as SEQ ID NO:155. Nucleotides 66 to 2158 of SEQ ID NO:151 align with nucleotides 39 to 2131 of a *Rattus norvegicus* acetoacetyl-CoA synthetase cDNA (SEQ ID NO:156) with 83% sequence identity (1743/2093). Human 32252 contains the following structural features: one acetyl-CoA synthetase ACS-1 domain (Prodom 101494) located at about amino acid residues 13-122 of SEQ ID NO:152; one ligase synthetase protein enzyme biosynthesis antibiotic phosphopantetheine multifunctional repeat acyl-CoA domain (Prodom 43) located at about amino acid residues 130-420 of SEQ ID NO:152, which includes an AMP binding domain signature at about amino acid residues 287-298 of SEQ ID NO:152; one acetyl-CoA synthetase ACS-1 domain (Prodom 100407) located at about amino acid residues 555-660 of SEQ ID NO:152; and one acetyl-coenzyme A synthetase (NCB1 G1:1118129) domain (Prodom 91186) located at about amino acid residues 580-661 of SEQ ID NO:152.

The 32252 protein additionally includes: two N-glycosylation sites (PS00001) located at about amino acids 320 to 323 and 449 to 452 of SEQ ID NO:152; one cAMP- and cGMP-dependent protein kinase phosphorylation site located at about amino acids 24 to 27 of SEQ ID NO:152; four Protein Kinase C sites (PS00005) at about amino acids 23 to 25, 83 to 85, 243 to 245, and 612 to 614 of SEQ ID NO:152; eleven Casein Kinase II sites (PS00006) located at about amino acids 2 to 5, 27 to 30, 46 to 49, 57 to 60, 130 to 133, 183 to 186, 243 to 246, 322 to 325, 386 to 389, 562 to 565, and 655 to 658 of SEQ ID NO:152; eleven N-myristoylation sites (PS00008) from about amino acids 37 to 42, 70 to 75, 96 to 101, 149 to 154, 177 to 182, 295 to 300, 319 to 324, 433 to 438, 548 to 553, 625 to 630, and 651 to 656 of SEQ ID NO:152; and one amidation site (PS00455) located at about amino acids 631 to 634 of SEQ ID NO:152.

32252 polypeptides of the invention include fragments which include: all or part of a hydrophobic sequence, e.g., the sequence from about amino acid 170 to 180, from about 335 to 355, and from about 430 to 450 of SEQ ID NO:152; all or part of a hydrophilic sequence, e.g., the sequence of from about amino acid 210 to 225, and from about 495 to 510 of SEQ ID NO:152.

For general information regarding PFAM identifiers, PS prefix and PF prefix domain identification numbers, refer to Sonnhammer et al. (1997) *Protein* 28:405-420.

A plasmid containing the nucleotide sequence encoding human 32252 (clone "Fbh32252FL") was deposited with American Type Culture Collection (ATCC), 10801 University Boulevard, Manassas, Va. 20110-2209, on Jun. 1, 2001 and assigned Accession Number PTA-3425. This deposit will be maintained under the terms of the Budapest Treaty on the International Recognition of the Deposit of Microorganisms for the Purposes of Patent Procedure. This deposit was made merely as a convenience for those of skill in the art and is not an admission that a deposit is required under 35 U.S.C. §112.

The 32252 protein contains a significant number of structural characteristics in common with members of the AMP-binding enzyme family. The term "family" when referring to the protein and nucleic acid molecules of the invention means two or more proteins or nucleic acid molecules having a common structural domain or motif and having sufficient amino acid or nucleotide sequence homology as defined herein. Such family members can be naturally or non-naturally occurring and can be from either the same or different species. For example, a family can contain a first protein of human origin as well as other distinct proteins of human origin, or alternatively, can contain homologues of non-human origin, e.g., rat or mouse proteins. Members of a family can also have common functional characteristics.

Acyl-CoA synthases are classified on the basis of their activity in conjugating saturated fatty acids of differing chain lengths, i.e., short (C2-C4), medium (C4-C12), long (C10-C22), and very long (greater than C22). These enzymes are located in various cell compartments (e.g., cytosol, smooth endoplasmic reticulum, mitochondria and peroxisomes). They exhibit wide tissue distribution, but are most abundant in liver and adipose tissue (Knights, 1998, *Clin. Exp. Pharmacol. Physiol.* 25:776-782). In mammals, activation of fatty acids is the first step in fatty acid metabolism. Long-chain fatty acyl-CoA synthetases catalyze esterification of fatty acids into CoA thioesters, which are used either for lipid biosynthesis or oxidized and used as a cellular energy source (Conti et al., 1996, *Structure* 4:287-298). Formation of acyl-CoA occurs with xenobiotic carboxylic acids as well as with endogenous substrates.

Defects in AMP-binding enzymes can give rise to serious disorders. Adrenoleukodystrophy (X-ALD) is a genetic disorder inherited as an X-linked recessive trait. It involves defective peroxisomal oxidation of very long chain fatty acids (VLCFA). The disorder is characterized by demyelination of the central nervous system, and by adrenal insufficiency. Saturated very long chain fatty acids accumulate as a result of impaired activity of VLC acyl-CoA synthetase (VLCAS). The gene that causes X-ALD codes for a peroxisomal integral membrane protein (ALDP). ALDP appears to be involved in stabilizing VLCAS activity, possibly through protein-protein interactions. Loss or impairment of this protein-protein interaction may account for the loss of peroxisomal VLCAS activity in X-ALD (Smith et al., 2000, *Exp. Cell Res.* 254:309-320).

Overexpression of both VLCAS and ALDP in X-ALD fibroblasts synergistically increases very long chain fatty acid β-oxidation, indicating that these proteins interact functionally (Steinberg et al., 1999, *Ann. Neurol.* 46:409-412; Yamada et al., 1999, *Neurology* 52:614-616).

Acetoacetyl-CoA synthetase has been purified from rat liver (Ito et al., 1984, *Biochim. Biophys. Acta* 794:183-193). A cDNA encoding this enzyme has been cloned from a rat liver cDNA library and sequenced (Iwahori et al., 2000, *FEBS Lett.* 466:239-243). Acetoacetyl-CoA synthetase catalyzes the following reaction:

acetoacetate+CoASH+ATP→acetoacetyl-CoA+ AMP+PP$_i$.

In mammals, acetoacetyl-CoA synthetase is a cytosolic enzyme found in various tissues and is most abundant in lipogenic tissues (Bergstrom et al., 1984, *J. Biol. Chem.* 259: 14548-14553; Ito et al., 1986, *Biochim. Biophys Acta* 876: 280-287; Yeh, 1982, *Int. J. Biochem.* 14:81-86; Bunckley et al., 1975, *FEBS Lett.* 60:7-10). This enzyme is found, e.g., in liver, infant brain, lactating mammary gland, and adipose tissue. Acetoacetate is used preferentially for cholesterol biosynthesis. In rats, acetoacetate synthetase activity is depressed by cholesterol feeding or mevalonate administration, and activity is increased by feeding mevinolin or cholestyramine (Bergstrom et al., supra).

The AMP-binding domain family of proteins is characterized by a common fold, the structure of which was solved for firefly luciferase (Conti et al. (1996), *Structure* 4(3):287-298). Based on the luciferase structure, the AMP-binding domain is composed of two subdomains: a compact N-terminal subdomain that contains a distorted antiparallel θ-barrel and two θ-sheets, which are flanked on either side by θ-helices; and a small I+θ C-terminal subdomain (Conti et al., supra). The two θ-sheets pack together to create a long surface groove, which is closed at one end by the presence of the θ-barrel. The packing of the θ-barrel against the side of the two θ-sheets forms two shallow depressions on the concave surface of the molecule, giving rise to a Y-shaped valley on the surface of the N-terminal subdomain. The C-terminal subdomain is connected to the N-terminal subdomain by a flexible hinge and is positioned above the b-barrel portion of the N-terminal subdomain such that a large cleft is formed between the N-terminal and C-terminal subdomains.

Several conserved sequence motifs have been identified in the AMP-binding domain family of proteins. The conserved sequence motifs include the "AMP-binding domain signature motif", defined by the sequence [STG]-[STG]-G-[ST]-[TSE]-[GS]-X-[PALIVM]-K, as well as an "invariant glutamine motif" defined by the sequences [YFW]-[GASW]-X-[TSA]-E, and an "invariant aspartic acid motif" defined by the sequence [STA]-[GRK]-D. Due to the conservation these motifs in a family of molecules that have distinct enzymatic activities, the motifs are believed to function in the binding of AMP and in adenylate formation, properties shared by all of the members of the family (Conti et al., supra).

A 32252 polypeptide can include a "AMP-binding domain" or regions homologous with a "AMP-binding domain".

As used herein, the term "AMP-binding domain" includes an amino acid sequence of about 70 to 300 amino acid residues in length and having a score for the alignment of the sequence to the AMP-binding domain (Prodom) of at least 50, more preferably at least 75, 100, or 200. In some embodiments, an AMP-binding domain includes about 70 to 90 amino acids, and has a score for the alignment of the sequence to the AMP-binding domain (Prodom) of 150 or greater. In other embodiments, the AMP-binding domain includes about 100 to 120 amino acids and has a score for the alignment of the sequence to the AMP-binding domain (Prodom) of 150 or greater. In still other embodiments, the AMP-binding domain includes about 280 to 300 amino acids and has a score for the alignment of the sequence to the AMP-binding domain (Prodom) of 150 or greater.

In a preferred embodiment 32252 polypeptide or protein has a "AMP-binding domain" or a region which includes about 70 to 300, and preferably about 70 to 90, 100 to 120, or 280 to 300 amino acid residues and has at least about 50%, 60%, 70% 80% 90% 95%, 99%, or 100% homology with an "AMP-binding domain," e.g., one of the AMP-binding domains of human 32252 (e.g., residues 67 to 504 of SEQ ID NO:152).

To identify the presence of a "AMP binding" domain in a 32252 protein sequence, and make the determination that a polypeptide or protein of interest has a particular profile, the amino acid sequence of the protein can be searched against a database of domains, e.g., the ProDom database (Corpet et al. (1999), *Nucl. Acids Res.* 27:263-267) The ProDom protein domain database consists of an automatic compilation of homologous domains. Current versions of ProDom are built using recursive PSI-BLAST searches (Altschul S F et al. (1997) *Nucleic Acids Res.* 25:3389-3402; Gouzy et al. (1999) *Computers and Chemistry* 23:333-340.) of the SWISS-PROT 38 and TREMBL protein databases. The database automatically generates a consensus sequence for each domain. A BLAST search was performed against the ProDom database resulting in the identification of an "AMP binding" domain in the amino acid sequence of human 32252 at about residues 67 to 504 of SEQ ID NO:152.

A 32252 family member can include at least one predicted acetyl-CoA synthetase ACS-1 domain (Prodom 101494). Furthermore a 32252 family member can include at least one AMP-binding domain (PS00455); at least one, preferably two predicted N-glycosylation sites (PS00001); at least one predicted cAMP- and cGMP-dependent protein kinase phosphorylation site (PS00004); at least one, two, three, preferably four predicted Protein Kinase C sites (PS00005); at least one, two, three, four, five, six, seven, eight, nine, ten, preferably eleven predicted Casein Kinase II sites (PS00006); at least one, two, three, four, five, six, seven, eight, nine, ten, preferably eleven predicted N-myristoylation sites (PS00008); and at least one amidation site (PS00009).

As the 32252 polypeptides of the invention may modulate 32252-mediated activities, they may be useful as of for developing novel diagnostic and therapeutic agents for 32252-mediated or related disorders, as described below.

As used herein, a "32252 activity", "biological activity of 32252" or "functional activity of 32252", refers to an activity exerted by a 32252 protein, polypeptide or nucleic acid molecule on e.g., a 32252-responsive cell or on a 32252 substrate, e.g., a protein substrate, as determined in vivo or in vitro. In one embodiment, a 32252 activity is a direct activity, such as acyl-CoA ligase activity, e.g., acetoacetyl-CoA synthetase. A "target molecule" or "binding partner" is a molecule with which a 32252 protein binds or interacts in nature, e.g., a peroxisomal integral membrane protein (ALDP). For example, the 32252 proteins of the present invention can have one or more of the following activities: (1) acyl-CoA ligase activity; (2) promotion of fatty acid metabolism and/or cholesterol metabolism; (3) recycling of acetoacetate; (4) promotion of xenobiotic carboxylic acid metabolism; (5) regulation and/or mediation of cellular growth, particularly of tumor cells; and/or (6) a agonizing or antagonizing (1)-(5).

The 32252 polypeptide is predicted to be a membrane associated protein that displays enzymatic activity. The 32252 polypeptide is predicted to be localized in various cell compartments, e.g., cytosol, smooth endoplasmic reticulum, mitochondria and peroxisomes. The 32252 enzymatic activity is predicted to include acyl-CoA ligase activity, e.g., esterification of fatty acids (short, medium, long or very long chain) into CoA thioesters, which are used for lipid biosynthesis or oxidized and used as a cellular energy source.

As shown in the Examples below, expression of human 32252 has been detected in a wide range of tissues, including brain, cardiovascular tissues (e.g., human vascular endothelial cells), ovary, lung, breast, and colon tissues (refer to Tables 48-50, below). Expression of human 32252 was increased in many breast tumor, ovary tumor, lung tumor, and colon tumor samples, relative to its levels in normal breast, ovary, lung, and colon tissues (refer to Tables 49 and 50, below).

Notably, human 32252 mRNA is overexpressed in lung tumor cells grown in soft agar relative to the same cells grown on plastic. Soft agar simulates the milieu of a tumor cell.

Thus, the 32252 molecules can act as novel diagnostic targets and therapeutic agents for controlling lipid metabolic disorders, cellular proliferative and/or differentiative disorders, cardiovascular disorders, breast disorders, colon disorders, ovarian disorders, lung disorders, and neural disorders.

The 32252 molecules can act as novel diagnostic targets and therapeutic agents for controlling one or more of cellular proliferative and/or differentiative disorders, or metabolic disorders.

Identification and Characterization of Human 32252 cDNA

The human 32252 nucleic acid sequence is recited as follows:

(SEQ ID NO: 151)
GCCGCCGCCGTCGCTGACCCAGCCCGCCAGGCGCTCCTGACCGTCGCTTC

GTCCGGTCCCAGGTCCCCGGCCCTCGCCTCAGCCCCGGCCCCTGGTCCCC

AGCCCTCGTCGCAGCCCCGGCCGCCCGCCGCCGCCATGTCCAAGGAGGAG

CGCCCCGGTCGGGAGGAGATCCTGGAGTGCCAGGTGATGTGGGAGCCTGA

CAGTAAGAAGAACACGCAGATGGACCGCTTCCGGGCGGCTGTGGGCGCCG

CCTGCGGCCTGGCGCTGGAGAGTTATGATGACTTGTACCATTGGTCCGTT

GAGTCATATTCAGACTTCTGGGCAGAGTTCTGGAAATTCAGTGGAATTGT

CTTCTCACGTGTGTATGATGAGGTTGTGGACACATCGAAAGGAATCGCAG

ATGTCCCCGAGTGGTTCAAAGGCAGTCGGCTCAACTATGCAGAAAACCTC

CTGCGGCACAAAGAGAATGACAGAGTTGCCCTTTACATTGCAAGGGAAGG

CAAAGAGGAAATTGTGAAGGTGACTTTTGAAGAGCTGAGGCAAGAAGTGG

CTTTGTTTGCAGCAGCAATGAGGAAAATGGGTGTGAAGAAGGAGATCGG

GTTGTTGGTTATTTACCCAACAGTGAGCACGCTGTCGAGGCGATGCTGGC

TGCGGCAAGCATTGGTGCCATCTGGAGCTCCACGTCCCCGGACTTCGGTG

TGAATGGTGTGCTGGACCGGTTTTCTCAAATTCAGCCAAAGCTCATCTTC

TCTGTGGAGGCTGTTGTCTATAATGGCAAAGAGCACAACCACATGGAAAA

GCTGCAGCAGGTGGTTAAAGGCCTACCAGACTTGAAGAAAGTGGTGGTGA

TTCCTTATGTGTCCTCCAGAGAGAACATAGACCTTTCAAAGATTCCAAAC

AGTGTGTTTCTGGATGACTTTCTTGCCACCGGCACCAGTGAGCAGGCCCC

GCAGCTGGAGTTCGAGCAGCTGCCCTTCAGCCACCCACTGTTCATCATGT

TCTCATCGGGCACCACGGGCGCACCCAAGTGCATGGTGCATTCCGCTGGG

GGCACCCTCATCCAGCATCTGAAGGAGCACCTGCTGCACGGCAACATGAC

CAGCAGTGACATCCTCCTGTGCTACACCACGGTCGGCTGGATGATGTGGA

ACTGGATGGTGTCCCTTCTGGCCACAGGAGCGGCCATGGTCTTGTACGAT

GGCTCCCCCCTGGTGCCCACGCCCAATGTGCTCTGGGACCTGGTTGACAG

GATAGGCATCACTGTCCTGGTAACTGGGGCCAAGTGGCTGTCAGTGCTGG

AAGAGAAGGCCATGAAGCCGGTGGAAACCCACAGTCTCCAGATGCTCCAC

ACGATCCTGTCCACTGGCTCCCCACTGAAAGCCCAGAGCTACGAGTATGT

CTACAGGTGCATCAAGAGCAGCATCCTCCTGGGCTCCATCTCAGGAGGCA

CCGACATCATCTCCTGCTTCATGGGCCACAATTTTTCTCTTCCTGTGTAT

AAAGGGGAGATTCAGGCCCGGAACCTGGGCATGGCCGTGGAAGCGTGGAA

CGAGGAAGGAAAGGCGGTCTGGGGAGAGAGCGGCGAGCTGGTGTGTACTA

AGCCGATCCCTTGCCAGCCCACACACTTCTGGAACGATGAGAACGGCAAC

AAGTACAGGAAGGCGTATTTCTCCAAATTCCCAGGTATCTGGGCTCATGG

CGACTACTGCAGAATCAACCCCAAGACCGGGGGCATCGTCATGCTTGGCC

GGAGTGACGGCACCCTCAACCCCAACGGGGTGCGGTTCGGCAGCTCGGAA

ATCTATAACATTGTGGAATCCTTCGAGGAGGTGGAGGACAGCCTGTGTGT

CCCCCAGTATAACAAGTACAGGGAGGAGAGGGTGATCCTCTTCCTGAAGA

-continued

```
TGGCCTCCGGGCACGCCTTCCAGCCTGACTTGGTTAAGAGGATCCGTGAC

GCCATCCGCATGGGCTTGTCTGCGCGACACGTGCCCAGCCTCATCCTGGA

AACCAAGGGCATCCCGTATACGCTCAACGGCAAGAAAGTGGAAGTTGCCG

TCAAACAGATCATCGCTGGAAAAGCCGTGGAGCAAGGAGGTGCTTTCTCG

AACCCCGAGACCCTGGATCTGTACCGGGACATCCCTGAGCTGCAGGGCTT

CTGAGTCAGACTGGCTGGCGTGTCACTCAGCCGCACCCGTGTGCACTGTA

ACTTTTGTGTGCTCAAGAAATTATACAGAAACCTACAGCTGTTGTAAAAG

GATGCTCGCACCAAGTGTTCTGTAGGCTTGGGGAGGGATCGTTTCTCTGT

TTTGTTAAATCTGGTGGGTACCTGGATCTTCCACACGAGTGGGATTCTGG

CCTTCAGAGACCAGGAGGGAGTGTCTGGGCCGCAGGTGTGGCACTGTGGT

GAGAGTGTGTGTCTTTGCACACACAGTGCAGCGGGAACGGTGGGGCTGGC

TGGTGCTGAAGACAGACACACTCCTGAGCCAAGGTCTTGTCTTCAACCTC

CCCGTCCCGTTGTCCCATTTTGCTCTGTGAAGGTGCAAATCCCTTTCTTC

CCTTCCCATCTCAGGCTCTCCTGTTTTCCCTCAGGGTCCAGTATGCCCTT

TGAGCTTTAGCTGTTAGAAAGCAAC.
```

The human 32252 sequence (SEQ ID NO:151), which is approximately 2625 nucleotides long. The nucleic acid sequence includes an initiation codon (ATG) and a termination codon (TAA) which are underscored and bolded above. The region between and inclusive of the initiation codon and the termination codon is a methionine-initiated coding sequence of about 2019 nucleotides, including the termination codon (nucleotides indicated as "coding" of SEQ ID NO:151; SEQ ID NO:153). The coding sequence encodes a 672 amino acid protein (SEQ ID NO:152), which is recited as follows:

```
                                              (SEQ ID NO: 152)
MSKEERPGREEILECQVMWEPDSKKNTQMDRFRAAVGAACGLALESYDDL

YHWSVESYSDFWAEFWKFSGIVFSRVYDEVVDTSKGIADVPEWFKGSRLN

YAENLLRHKENDRVALYIAREGKEEIVKVTFEELRQEVALFAAAMRKMGV

KKGDRVVGYLPNSEHAVEAMLAAASIGAIWSSTSPDFGVNGVLDRFSQIQ

PKLIFSVEAVVYNGKEHNHMEKLQQVVKGLPDLKKVVVIPYVSSRENIDL

SKIPNSVFLDDFLATGTSEQAPQLEFEQLPFSHPLFIMFSSGTTGAPKCM

VHSAGGTLIQHLKEHLLHGNMTSSDILLCYTTVGWMMWNWMVSLLATGAA

MVLYDGSPLVPTPNVLWDLVDRIGITVLVTGAKWLSVLEEKAMKPVETHS

LQMLHTILSTGSPLKAQSYEYVYRCIKSSILLGSISGGTDIISCFMGHNF

SLPVYKGEIQARNLGMAVEAWNEEGKAVWGESGELVCTKPIPCQPTHFWN

DENGNKYRKAYFSKFPGIWAHGDYCRINPKTGGIVMLGRSDGTLNPNGVR

FGSSEIYNIVESFEEVEDSLCVPQYNKYREERVILFLKMASGHAFQPDLV

KRIRDAIRMGLSARHVPSLILETKGIPYTLNGKKVEVAVKQIIAGKAVEQ

GGAFSNPETLDLYRDIPELQGF.
```

Tissue Distribution of 32252 mRNA by TaqMan® Analysis

Endogenous human 32252 gene expression was determined using the Perkin-Elmer/ABI 7700 Sequence Detection System which employs TaqMan® technology. Briefly, TaqMan® technology relies on standard RT-PCR with the addition of a third gene-specific oligonucleotide (referred to as a probe) which has a fluorescent dye coupled to its 5' end (typically 6-FAM) and a quenching dye at the 3' end, (typically TAMRA). When the fluorescently tagged oligonucleotide is intact, the fluorescent signal from the 5' dye is quenched. As PCR proceeds, the 5' to 3' nucleolytic activity of Taq polymerase digests the labeled primer, producing a free nucleotide labeled with 6-FAM, which is now detected as a fluorescent signal. The PCR cycle where fluorescence is first released and detected is directly proportional to the starting amount of the gene of interest in the test sample, thus providing a quantitative measure of the initial template concentration. Samples can be internally controlled by the addition of a second set of primers/probe specific for a housekeeping gene such as GAPDH which has been labeled with a different fluorophore on the 5' end (typically VIC).

To determine the level of 32252 in various human tissues a primer/probe set was designed. Total RNA was prepared from a series of human tissues using an RNeasy kit from Qiagen. First strand cDNA was prepared from 1 μg total RNA using an oligo-dT primer and Superscript II reverse transcriptase (Gibco/BRL). cDNA obtained from approximately 50 ng total RNA was used per TaqMan® reaction. Tissues tested include the human tissues and several cell lines shown in Tables 48-50. 32252 mRNA was detected include artery, coronary smooth muscle cells (SMC), heart, human umbilical vein endothelial cells (HUVECs), kidney, pancreas, adipose, epithelial, brain and other nerve tissue of the central nervous system, breast, prostate, colon, lung, and megakaryocyte, and erythroid tissues (Table 48). 32252 expression was also found in breast tumors, lung tumors, ovary tumors, and colon tumors (Tables 49 and 50).

TABLE 48

Expression of 32252 with σ2

| Tissue Type | Relative Expression |
|---|---|
| Artery Normal | 1.6142 |
| Aorta Diseased | 0.4106 |
| Vein Normal | 0 |
| Coronary SMC (Smooth Muscle Cells) | 8.4901 |
| HUVEC (Human Umbilical Vein Endothelial Cells) | 10.3444 |
| Hemangioma | 0.206 |
| Heart Normal | 1.7121 |
| Heart CHF (Congestive Heart Failure) | 1.8542 |
| Kidney | 2.1671 |
| Skeletal Muscle | 0.7689 |
| Adipose Normal | 1.4649 |
| Pancreas | 3.8259 |
| Primary Osteoblasts | 0.4149 |
| Osteoclasts (differentiated) | 0.0135 |
| Skin Normal | 1.1735 |
| Spinal Cord Normal | 0.321 |
| Brain Cortex Normal | 51.8325 |
| Brain Hypothalamus Normal | 3.9334 |
| Nerve | 0.6223 |
| DRG (Dorsal Root Ganglion) | 4.3948 |
| Breast Normal | 4.4871 |
| Breast Tumor | 1.4397 |
| Ovary Normal | 1.5809 |
| Ovary Tumor | 0.1668 |
| Prostate Normal | 1.5271 |
| Prostate Tumor | 2.8007 |
| Salivary Glands | 1.835 |
| Colon Normal | 0.1936 |
| Colon Tumor | 3.4124 |
| Lung Normal | 0.0519 |
| Lung Tumor | 19.0377 |
| Lung COPD (Pulmonary Disease) | 0.2814 |

TABLE 48-continued

Expression of 32252 with σ2

| Tissue Type | Relative Expression |
| --- | --- |
| Colon IBD (Intestinal Bowel Disease) | 0.1041 |
| Liver Normal | 0.0723 |
| Liver Fibrosis | 0.231 |
| Spleen Normal | 0 |
| Tonsil Normal | 0.7174 |
| Lymph Node Normal | 0.1393 |
| Small Intestine Normal | 0.1345 |
| Skin-Decubitus | 0.1308 |
| Synovium | 0 |
| BM-MNC | 0 |
| Activated PBMC | 0.1175 |
| Neutrophils | 0.6354 |
| Megakaryocytes | 7.3146 |
| Erythroid | 16.0643 |

The mRNA expression data for 32252 mRNA tabulated in Table 48 indicated expression in a number of particular tissues. Tissues in which 32252 mRNA was detected include artery, coronary smooth muscle cells (SMC), heart, human umbilical vein endothelial cells (HUVECs), kidney, pancreas, adipose, epithelial, brain and other nerve tissue of the central nervous system, breast, prostate, colon, lung, and megakaryocyte, and erythroid tissues. Expression was particularly prominent in the brain, lung tumor, and erythroid tissue samples, and slightly less in coronary SMC, HUVEC, and megakaryocyte tissue samples. Expression is relative to β-macroglobulin.

TABLE 49

Expression of 32252 in Oncology

| Tissue Type | Relative Expression |
| --- | --- |
| PIT 400 Breast Normal | 20.33 |
| PIT 372 Breast Normal | 10.64 |
| CHT 558 Breast Normal | 6.00 |
| CLN 168 Breast Tumor: Invasive Ductal Carcinoma (IDC) | 8.23 |
| MDA 304 Breast Tumor: MD-Invasive Ductal Carcinoma | 6.37 |
| NDR 58 Breast Tumor: Invasive Ductal Carcinoma (IDC) | 4.60 |
| NDR 05 Breast Tumor: Invasive Ductal Carcinoma (IDC) | 152.83 |
| MCF-7 Breast Tumor | 86.87 |
| ZR75 Breast Tumor | 110.72 |
| T47D Breast Tumor | 70.32 |
| MDA 231 Breast Tumor | 14.33 |
| MDA 435 Breast Tumor | 9.75 |
| SKBr3 Breast | 35.65 |
| DLD 1 Colon Tumor (stageC) | 173.14 |
| SW480 Colon Tumor (stage B) | 60.58 |
| SW620 Colon Tumor (stageC) | 85.08 |
| HCT116 | 20.69 |
| HT29 | 14.63 |
| Colo 205 | 10.64 |
| NCIH125 | 59.54 |
| NCIH67 | 102.24 |
| NCIH322 | 27.30 |
| NCIH460 | 18.65 |
| A549 | 53.66 |
| NHBE | 38.21 |
| SKOV-3 Ovary | 5.90 |
| OVCAR-3 Ovary | 46.71 |
| 293 Baby Kidney | 88.08 |
| 293T Baby Kidney | 72.04 |

Tumor cell lines were xenografted into nude mice. Expression of human 32252 mRNA in tumors harvested from the mice was analyzed using TaqMan®. Results are tabulated in Table 50. The results indicated that, for example, 32252 mRNA is highly expressed in some xenografted colon tumor samples, some xenografted breast tumor samples, some xenografted lung tumor samples, and some xenografted ovary cell lines.

TABLE 50

Expression of 32252 in Lung Xenografts

| Xenografted Cell Line | Relative Expression |
| --- | --- |
| NHBE | 0.1 |
| A549 (BA) | 0.0 |
| H460 (LCLC) | 0.1 |
| H23 (adenocarcinoma) | 0.2 |
| H522 (adenocarcinoma) | 0.1 |
| H125 (adenocarcinoma/small cell carcinoma) | 0.4 |
| H520 (small cell carcinoma) | 0.1 |
| H69 (SCLC) | 0.1 |
| H324 (SCLC) | 0.3 |

32252 mRNA was expressed in a number of lung tumor cell lines when grown as xenografts in mice.

In situ hybridization procedures detected 32252 mRNA in a number of tissue samples:

Lung: No (1 of 2 samples) or weak (1 of 2 samples) expression was found in normal bronchiolar epithelium, but striking up regulation was detected in all histological subtypes of tumors (6 of 6 tumor samples).

Breast: 32252 mRNA was detected in normal breast tissue (3 of 3 samples) and breast tumors (2 of 2 samples).

Colon: 32252 mRNA was upregulated in primary tumors (2 of 2 samples) and liver metastases (4 of 4 samples) relative to normal.

Ovary: Ovarian tissues were positive for 32252 expression (3 of 3 samples) relative normal ovarian tissue.

32252 mRNA was also highly over expressed in lung tumor cells (for example, NCI-460 lung tumor cells) that are grown in soft agar (0.2 units) relative to the same cells grown on plastic (<0.05 units). This finding is indicative of association of 32252 overexpression with the metastatic state.

Tissue Distribution of 32252 mRNA by Northern Analysis

Northern blot hybridizations with various RNA samples can be performed under standard conditions and washed under stringent conditions, i.e., 0.2×SSC at 65° C. A DNA probe corresponding to all or a portion of the 32252 cDNA (SEQ ID NO:151) can be used. The DNA was radioactively labeled with $^{32}$P-dCTP using the Prime-It Kit (Stratagene, La Jolla, Calif.) according to the instructions of the supplier. Filters containing mRNA from mouse hematopoietic and endocrine tissues, and cancer cell lines (Clontech, Palo Alto, Calif.) can be probed in ExpressHyb hybridization solution (Clontech) and washed at high stringency according to manufacturer's recommendations.

DEFINITIONS

The 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein, fragments thereof, and derivatives and other variants of the sequence in SEQ ID NO:2, 5, 8, 11, 40, 55, 57, 60, 64, 67, 76, 80, 83, 90, 93, 96, 108, 113, 118, 121, 128, 140 or 152 thereof are collectively referred to as "polypeptides or proteins of the invention" or "13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptides or proteins". Nucleic acid molecules encoding such polypeptides or proteins are collectively referred to as "nucleic acids of the invention" or "13237, 18480, 2245, 16228, 7677, 26320, 46619, 33166, 16836, 46867, 21617, 55562, 39228, 62088, 46745, 23155, 21657, 42755, 32229, 22325, 46863 or 32252 nucleic acids."

As used herein, the term "nucleic acid molecule" includes DNA molecules (e.g., a cDNA or genomic DNA) and RNA molecules (e.g., an mRNA) and analogs of the DNA or RNA generated, e.g., by the use of nucleotide analogs. The nucleic acid molecule can be single-stranded or double-stranded, but preferably is double-stranded DNA.

The term "isolated or purified nucleic acid molecule" includes nucleic acid molecules which are separated from other nucleic acid molecules which are present in the natural source of the nucleic acid. For example, with regards to genomic DNA, the term "isolated" includes nucleic acid molecules which are separated from the chromosome with which the genomic DNA is naturally associated. Preferably, an "isolated" nucleic acid is free of sequences which naturally flank the nucleic acid (i.e., sequences located at the 5' and/or 3' ends of the nucleic acid) in the genomic DNA of the organism from which the nucleic acid is derived. For example, in various embodiments, the isolated nucleic acid molecule can contain less than about 5 kb, 4 kb, 3 kb, 2 kb, 1 kb, 0.5 kb or 0.1 kb of 5' and/or 3' nucleotide sequences which naturally flank the nucleic acid molecule in genomic DNA of the cell from which the nucleic acid is derived. Moreover, an "isolated" nucleic acid molecule, such as a cDNA molecule, can be substantially free of other cellular material or culture medium when produced by recombinant techniques, or substantially free of chemical precursors or other chemicals when chemically synthesized.

As used herein, the term "hybridizes under low stringency, medium stringency, high stringency, or very high stringency conditions" describes conditions for hybridization and washing. Guidance for performing hybridization reactions can be found in *Current Protocols in Molecular Biology* (1989) John Wiley & Sons, N.Y., 6.3.1-6.3.6, which is incorporated by reference. Aqueous and nonaqueous methods are described in that reference and either can be used. Specific hybridization conditions referred to herein are as follows: 1) low stringency hybridization conditions in 6× sodium chloride/sodium citrate (SSC) at about 45° C., followed by two washes in 0.2× SSC, 0.1% SDS at least at 50° C. (the temperature of the washes can be increased to 55° C. for low stringency conditions); 2) medium stringency hybridization conditions in 6×SSC at about 45° C., followed by one or more washes in 0.2×SSC, 0.1% SDS at 60° C.; 3) high stringency hybridization conditions in 6×SSC at about 45° C., followed by one or more washes in 0.2×SSC, 0.1% SDS at 65° C.; and preferably 4) very high stringency hybridization conditions are 0.5M sodium phosphate, 7% SDS at 65° C., followed by one or more washes at 0.2×SSC, 1% SDS at 65° C. Very high stringency conditions (4) are the preferred conditions and the ones that should be used unless otherwise specified.

As used herein, a "naturally-occurring" nucleic acid molecule refers to an RNA or DNA molecule having a nucleotide sequence that occurs in nature (e.g., encodes a natural protein).

As used herein, the terms "gene" and "recombinant gene" refer to nucleic acid molecules which include an open reading frame encoding a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein, preferably a mammalian 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein, and can further include non-coding regulatory sequences, and introns.

An "isolated" or "purified" polypeptide or protein is substantially free of cellular material or other contaminating proteins from the cell or tissue source from which the protein is derived, or substantially free from chemical precursors or other chemicals when chemically synthesized. In one embodiment, the language "substantially free" means preparation of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein having less than about 30%, 20%, 10% and more preferably 5% (by dry weight), of non-13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein (also referred to herein as a "contaminating protein"), or of chemical precursors or non-13237, 18480, 2245, 16228, 7677, 26320, 46619, 33166, 16836, 46867, 21617, 55562, 39228, 62088, 46745, 23155, 21657, 42755, 32229, 22325, 46863 or 32252 chemicals. When the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein or biologically active portion thereof is recombinantly produced, it is also preferably substantially free of culture medium, i.e., culture medium represents less than about 20%, more preferably less than about 10%, and most preferably less than about 5% of the volume of the protein preparation. The invention includes isolated or purified preparations of at least 0.01, 0.1, 1.0, and 10 milligrams in dry weight.

A "non-essential" amino acid residue is a residue that can be altered from the wild-type sequence of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 (e.g., the sequence of SEQ ID NO:1, 3, 4, 6, 7, 9, 10, 12, 39, 41, 54, 56, 58, 59, 61, 63, 65, 66, 68, 75, 77, 79, 81, 82, 84, 89, 91, 92, 94, 95, 97, 107, 109, 112, 114, 117, 119, 120, 122, 127, 129, 139, 141, 151 or 153) without abolishing or more preferably, without substantially altering a biological activity, whereas an "essential" amino acid residue results in such a change. For example, amino acid residues that are conserved among the polypeptides of the present invention, e.g., those present in the conserved domains, are predicted to be particularly unamenable to alteration.

A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Thus, a predicted nonessential amino acid residue in a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein is preferably replaced with another amino acid residue from the same side chain family. Alternatively, in another embodiment, mutations can be introduced randomly along all or part of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 coding sequence, such as by saturation mutagenesis, and the resultant mutants can be screened for 13237, 18480, 2245, 16228, 7677, 26320, 46619, 33166, 16836, 46867, 21617, 55562, 39228, 62088, 46745, 23155, 21657, 42755, 32229, 22325, 46863 or 32252 biological activity to identify mutants that retain activity. Following mutagenesis of SEQ ID NO:1, 3, 4, 6, 7, 9, 10, 12, 39, 41, 54, 56, 58, 59, 61, 63, 65, 66, 68, 75, 77, 79, 81, 82, 84, 89, 91, 92, 94, 95, 97, 107, 109, 112, 114, 117, 119, 120, 122, 127, 129, 139, 141, 151 or 153, the encoded protein can be expressed recombinantly and the activity of the protein can be determined.

As used herein, a "biologically active portion" of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein includes a fragment of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein which participates in an interaction between a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 molecule and a non-13237, 18480, 2245, 16228, 7677, 26320, 46619, 33166, 16836, 46867, 21617, 55562, 39228, 62088, 46745, 23155, 21657, 42755, 32229, 22325, 46863 or 32252 molecule. Biologically active portions of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein include peptides comprising amino acid sequences sufficiently homologous to or derived from the amino acid sequence of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein, e.g., the amino acid sequence shown in SEQ ID NO:2, 5, 8, 11, 40, 55, 57, 60, 64, 67, 76, 80, 83, 90, 93, 96, 108, 113, 118, 121, 128, 140 or 152, which include fewer amino acids than the full length 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein, and exhibit at least one activity of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein. Typically, biologically active portions comprise a domain or motif with at least one activity of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein. A biologically active portion of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein can be a polypeptide which is, for example, 10, 25, 50, 100, 200 or more amino acids in length. Biologically active portions of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein can be used as targets for developing agents which modulate a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 mediated activity.

Calculations of homology or sequence identity (the terms "homology" and "identity" are used interchangeably herein) between sequences are performed as follows:

To determine the percent identity of two amino acid sequences, or of two nucleic acid sequences, the sequences are aligned for optimal comparison purposes (e.g., gaps can be introduced in one or both of a first and a second amino acid or nucleic acid sequence for optimal alignment and non-homologous sequences can be disregarded for comparison purposes). In a preferred embodiment, the length of a reference sequence aligned for comparison purposes is at least 30%, preferably at least 40%, more preferably at least 50%, even more preferably at least 60%, and even more preferably at least 70%, 80%, 90%, 100% of the length of the reference sequence. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein amino acid or nucleic acid "identity" is equivalent to amino acid or nucleic acid "homology"). The percent identity between the two sequences is a function of the number of identical positions shared by the sequences, taking into account the number of gaps, and the length of each gap, which need to be introduced for optimal alignment of the two sequences.

The comparison of sequences and determination of percent identity between two sequences can be accomplished using a mathematical algorithm. In a preferred embodiment, the percent identity between two amino acid sequences is determined using the Needleman and Wunsch (1970) *J. Mol. Biol.* 48:444-453 algorithm which has been incorporated into the GAP program in the GCG software package using either a Blossum 62 matrix or a PAM250 matrix, and a gap weight of 16, 14, 12, 10, 8, 6, or 4 and a length weight of 1, 2, 3, 4, 5, or 6. In yet another preferred embodiment, the percent identity between two nucleotide sequences is determined using the GAP program in the GCG software package using a NWSgapdna.CMP matrix and a gap weight of 40, 50, 60, 70, or 80 and a length weight of 1, 2, 3, 4, 5, or 6. A particularly preferred set of parameters (and the one that should be used if the practitioner is uncertain about what parameters should be applied to determine if a molecule is within a sequence identity or homology limitation of the invention) are a Blossum 62 scoring matrix with a gap penalty of 12, a gap extend penalty of 4, and a frameshift gap penalty of 5.

The percent identity between two amino acid or nucleotide sequences can be determined using the algorithm of Meyers and Miller ((1989) *CABIOS*, 4:11-17) which has been incorporated into the ALIGN program (version 2.0), using a PAM120 weight residue table, a gap length penalty of 12 and a gap penalty of 4.

The nucleic acid and protein sequences described herein can be used as a "query sequence" to perform a search against public databases to, for example, identify other family members or related sequences. Such searches can be performed using the NBLAST and XBLAST programs (version 2.0) of Altschul et al. (1990) *J. Mol. Biol.* 215:403-10. BLAST nucleotide searches can be performed with the NBLAST program, score=100, wordlength=12 to obtain nucleotide sequences homologous to 13237, 18480, 2245, 16228, 7677, 26320, 46619, 33166, 16836, 46867, 21617, 55562, 39228, 62088, 46745, 23155, 21657, 42755, 32229, 22325, 46863 or 32252 nucleic acid molecules of the invention. BLAST protein searches can be performed with the XBLAST program, score=50, wordlength=3 to obtain amino acid sequences homologous to 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein molecules of the invention. To obtain gapped alignments for comparison purposes, Gapped BLAST can be utilized as described in Altschul et al., (1997) *Nucleic Acids Res.* 25:3389-3402. When utilizing BLAST and Gapped BLAST programs, the default parameters of the respective programs (e.g., XBLAST and NBLAST) can be used.

Particular 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptides of the present invention have an amino acid sequence substantially identical to the amino acid sequence of SEQ ID NO:2, 5, 8, 11, 40, 55, 57, 60, 64, 67, 76, 80, 83, 90, 93, 96, 108, 113, 118, 121, 128, 140 or 152. In the context of an amino acid sequence, the term "substantially identical" is used herein to refer to a first amino acid that contains a sufficient or minimum number of amino acid residues that are i) identical to, or ii) conservative substitutions of aligned amino acid residues in a second amino acid sequence such that the first and second amino acid sequences can have a common structural domain and/or common functional activity. For example, amino acid sequences that contain a common structural domain having at least about 60%, or 65% identity, likely 75% identity, more likely 85%, 90%. 91%, 92%, 93%, 94%, 95%, 96%, 97%, 98% or 99% identity to SEQ ID NO:2, 5, 8, 11, 40, 55, 57, 60, 64, 67, 76, 80, 83, 90, 93, 96, 108, 113, 118, 121, 128, 140 or 152 are termed substantially identical.

In the context of nucleotide sequence, the term "substantially identical" is used herein to refer to a first nucleic acid sequence that contains a sufficient or minimum number of nucleotides that are identical to aligned nucleotides in a second nucleic acid sequence such that the first and second nucleotide sequences encode a polypeptide having common functional activity, or encode a common structural polypeptide domain or a common functional polypeptide activity. For example, nucleotide sequences having at least about 60%, or 65% identity, likely 75% identity, more likely 85%, 90%. 91%, 92%, 93%, 94%, 95%, 96%, 97%, 98% or 99% identity to SEQ ID NO:1, 3, 4, 6, 7, 9, 10, 12, 39, 41, 54, 56, 58, 59, 61, 63, 65, 66, 68, 75, 77, 79, 81, 82, 84, 89, 91, 92, 94, 95, 97, 107, 109, 112, 114, 117, 119, 120, 122, 127, 129, 139, 141, 151 or 153 are termed substantially identical.

"Misexpression or aberrant expression", as used herein, refers to a non-wild type pattern of gene expression, at the RNA or protein level. It includes: expression at non-wild type levels, i.e., over or under expression; a pattern of expression that differs from wild type in terms of the time or stage at which the gene is expressed, e.g., increased or decreased expression (as compared with wild type) at a predetermined developmental period or stage; a pattern of expression that differs from wild type in terms of decreased expression (as compared with wild type) in a predetermined cell type or tissue type; a pattern of expression that differs from wild type in terms of the splicing size, amino acid sequence, post-transitional modification, or biological activity of the expressed polypeptide; a pattern of expression that differs from wild type in terms of the effect of an environmental stimulus or extracellular stimulus on expression of the gene, e.g., a pattern of increased or decreased expression (as compared with wild type) in the presence of an increase or decrease in the strength of the stimulus.

"Subject", as used herein, can refer to a mammal, e.g., a human, or to an experimental or animal or disease model. The subject can also be a non-human animal, e.g., a horse, cow, goat, or other domestic animal.

A "purified preparation of cells", as used herein, refers to, in the case of plant or animal cells, an in vitro preparation of cells and not an entire intact plant or animal. In the case of cultured cells or microbial cells, it consists of a preparation of at least 10% and more preferably 50% of the subject cells.

As used herein, cellular proliferative and/or differentiative disorders include cancer, e.g., carcinoma, sarcoma, metastatic disorders or hematopoietic neoplastic disorders, e.g., leukemias. A metastatic tumor can arise from a multitude of primary tumor types, including but not limited to those of prostate, colon, lung, breast and liver origin.

As used herein, the term "cancer" (also used interchangeably with the terms, "hyperproliferative" and "neoplastic") refers to cells having the capacity for autonomous growth, i.e., an abnormal state or condition characterized by rapidly proliferating cell growth. Cancerous disease states may be categorized as pathologic, i.e., characterizing or constituting a disease state, e.g., malignant tumor-growth, or may be categorized as non-pathologic, i.e., a deviation from normal but not associated with a disease state, e.g., cell proliferation associated with wound repair. The term is meant to include all types of cancerous growths or oncogenic processes, metastatic tissues or malignantly transformed cells, tissues, or organs, irrespective of histopathologic type or stage of invasiveness. The term "cancer" includes malignancies of the various organ systems, such as those affecting lung, breast, thyroid, lymphoid, gastrointestinal, and genito-urinary tract, as well as adenocarcinomas which include malignancies such as most colon cancers, renal-cell carcinoma, prostate cancer and/or testicular tumors, non-small cell carcinoma of the lung, cancer of the small intestine and cancer of the esophagus. The term "carcinoma" is art recognized and refers to malignancies of epithelial or endocrine tissues including respiratory system carcinomas, gastrointestinal system carcinomas, genitourinary system carcinomas, testicular carcinomas, breast carcinomas, prostatic carcinomas, endocrine system carcinomas, and melanomas. Exemplary carcinomas include those forming from tissue of the cervix, lung, prostate, breast, head and neck, colon and ovary. The term "carcinoma" also includes carcinosarcomas, e.g., which include malignant tumors composed of carcinomatous and sarcomatous tissues. An "adenocarcinoma" refers to a carcinoma derived from glandular tissue or in which the tumor cells form recognizable glandular structures. The term "sarcoma" is art recognized and refers to malignant tumors of mesenchymal derivation.

Examples of cellular proliferative and/or differentiative disorders of the lung include, but are not limited to, tumors such as bronchogenic carcinoma, including paraneoplastic syndromes, bronchioloalveolar carcinoma, neuroendocrine tumors, such as bronchial carcinoid, miscellaneous tumors, metastatic tumors, and pleural tumors, including solitary fibrous tumors (pleural fibroma) and malignant mesothelioma.

Examples of cellular proliferative and/or differentiative disorders of the breast include, but are not limited to, proliferative breast disease including, e.g., epithelial hyperplasia, sclerosing adenosis, and small duct papillomas; tumors, e.g., stromal tumors such as fibroadenoma, phyllodes tumor, and sarcomas, and epithelial tumors such as large duct papilloma; carcinoma of the breast including in situ (noninvasive) carcinoma that includes ductal carcinoma in situ (including Paget's disease) and lobular carcinoma in situ, and invasive (infiltrating) carcinoma including, but not limited to, invasive ductal carcinoma, invasive lobular carcinoma, medullary carcinoma, colloid (mucinous) carcinoma, tubular carcinoma, and invasive papillary carcinoma, and miscellaneous malignant neoplasms. Disorders in the male breast include, but are not limited to, gynecomastia and carcinoma.

Examples of cellular proliferative and/or differentiative disorders involving the colon include, but are not limited to, tumors of the colon, such as non-neoplastic polyps, adenomas, familial syndromes, colorectal carcinogenesis, colorectal carcinoma, and carcinoid tumors.

Examples of cancers or neoplastic conditions, in addition to the ones described above, include, but are not limited to, a fibrosarcoma, myosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, Ewing's tumor, leiomyosarcoma, rhabdomyosarcoma, gastric cancer, esophageal cancer, rectal cancer, pancreatic cancer, ovarian cancer, prostate cancer, uterine cancer, cancer of the head and neck, skin cancer, brain cancer, squamous cell carcinoma, sebaceous gland carcinoma, papillary carcinoma, papillary adenocarcinoma, cystadenocarcinoma, medullary carcinoma, bronchogenic carcinoma, renal cell carcinoma, hepatoma, bile duct carcinoma, choriocarcinoma, seminoma, embryonal carcinoma, Wilm's tumor, cervical cancer, testicular cancer, small cell lung carcinoma, non-small cell lung carcinoma, bladder carcinoma, epithelial carcinoma, glioma, astrocytoma, medulloblastoma, craniopharyngioma, ependymoma, pinealoma, hemangioblastoma, acoustic neuroma, oligodendroglioma, meningioma, melanoma, neuroblastoma, retinoblastoma, leukemia, lymphoma, or Kaposi sarcoma.

Proliferative disorders include hematopoietic neoplastic disorders. As used herein, the term "hematopoietic neoplastic disorders" includes diseases involving hyperplastic/neoplastic cells of hematopoietic origin, e.g., arising from myeloid, lymphoid or erythroid lineages, or precursor cells thereof. Preferably, the diseases arise from poorly differentiated acute leukemias, e.g., erythroblastic leukemia and acute megakaryoblastic leukemia. Additional exemplary myeloid disorders include, but are not limited to, acute promyeloid leukemia (APML), acute myelogenous leukemia (AML) and chronic myelogenous leukemia (CML) (reviewed in Vaickus (1991) *Crit. Rev. in Oncol./Hemotol.* 11:267-97); lymphoid malignancies include, but are not limited to acute lymphoblastic leukemia (ALL) which includes B-lineage ALL and T-lineage ALL, chronic lymphocytic leukemia (CLL), prolymphocytic leukemia (PLL), hairy cell leukemia (HLL) and Waldenstrom's macroglobulinemia (WM). Additional forms of malignant lymphomas include, but are not limited to non-Hodgkin lymphoma and variants thereof, peripheral T cell lymphomas, adult T cell leukemia/lymphoma (ATL), cutaneous T-cell lymphoma (CTCL), large granular lymphocytic leukemia (LGF), Hodgkin's disease and Reed-Sternberg disease.

As used herein, disorders of the breast include, but are not limited to, disorders of development; inflammations, including but not limited to, acute mastitis, periductal mastitis, periductal mastitis (recurrent subareolar abscess, squamous metaplasia of lactiferous ducts), mammary duct ectasia, fat necrosis, granulomatous mastitis, and pathologies associated with silicone breast implants; fibrocystic changes; proliferative breast disease including, but not limited to, epithelial hyperplasia, sclerosing adenosis, and small duct papillomas; tumors including, but not limited to, stromal tumors such as fibroadenoma, phyllodes tumor, and sarcomas, and epithelial tumors such as large duct papilloma; carcinoma of the breast including in situ (noninvasive) carcinoma that includes ductal carcinoma in situ (including Paget's disease) and lobular carcinoma in situ, and invasive (infiltrating) carcinoma including, but not limited to, invasive ductal carcinoma, no special type, invasive lobular carcinoma, medullary carcinoma, colloid (mucinous) carcinoma, tubular carcinoma, and invasive papillary carcinoma, and miscellaneous malignant neoplasms. Disorders in the male breast include, but are not limited to, gynecomastia and carcinoma.

As used herein, disorders involving the colon include, but are not limited to, congenital anomalies, such as atresia and stenosis, Meckel diverticulum, congenital aganglionic megacolon-Hirschsprung disease; enterocolitis, such as diarrhea and dysentery, infectious enterocolitis, including viral gastroenteritis, bacterial enterocolitis, necrotizing enterocolitis, antibiotic-associated colitis (pseudomembranous colitis), and collagenous and lymphocytic colitis, miscellaneous intestinal inflammatory disorders, including parasites and protozoa, acquired immunodeficiency syndrome, transplantation, drug-induced intestinal injury, radiation enterocolitis, neutropenic colitis (typhlitis), and diversion colitis; idiopathic inflammatory bowel disease, such as Crohn disease and ulcerative colitis; tumors of the colon, such as non-neoplastic polyps, adenomas, familial syndromes, colorectal carcinogenesis, colorectal carcinoma, and carcinoid tumors.

As used herein, disorders involving the kidney include, but are not limited to, congenital anomalies including, but not limited to, cystic diseases of the kidney, that include but are not limited to, cystic renal dysplasia, autosomal dominant (adult) polycystic kidney disease, autosomal recessive (childhood) polycystic kidney disease, and cystic diseases of renal medulla, which include, but are not limited to, medullary sponge kidney, and nephronophthisis-uremic medullary cystic disease complex, acquired (dialysis-associated) cystic disease, such as simple cysts; glomerular diseases including pathologies of glomerular injury that include, but are not limited to, in situ immune complex deposition, that includes, but is not limited to, anti-GBM nephritis, Heymann nephritis, and antibodies against planted antigens, circulating immune complex nephritis, antibodies to glomerular cells, cell-mediated immunity in glomerulonephritis, activation of alternative complement pathway, epithelial cell injury, and pathologies involving mediators of glomerular injury including cellular and soluble mediators, acute glomerulonephritis, such as acute proliferative (poststreptococcal, postinfectious) glomerulonephritis, including but not limited to, poststreptococcal glomerulonephritis and nonstreptococcal acute glomerulonephritis, rapidly progressive (crescentic) glomerulonephritis, nephrotic syndrome, membranous glomerulonephritis (membranous nephropathy), minimal change disease (lipoid nephrosis), focal segmental glomerulosclerosis, membranoproliferative glomerulonephritis, IgA nephropathy (Berger disease), focal proliferative and necrotizing glomerulonephritis (focal glomerulonephritis), hereditary nephritis, including but not limited to, Alport syndrome and thin membrane disease (benign familial hematuria), chronic glomerulonephritis, glomerular lesions associated with systemic disease, including but not limited to, systemic lupus erythematosus, Henoch-Schönlein purpura, bacterial endocarditis, diabetic glomeruloscierosis, amyloidosis, fibrillary and immunotactoid glomerulonephritis, and other systemic disorders; diseases affecting tubules and interstitium, including acute tubular necrosis and tubulointerstitial nephritis, including but not limited to, pyelonephritis and urinary tract infection, acute pyelonephritis, chronic pyelonephritis and reflux nephropathy, and tubulointerstitial nephrifis induced by drugs and toxins, including but not limited to, acute drug-induced interstitial nephritis, analgesic abuse nephropathy, nephropathy associated with nonsteroidal anti-inflammatory drugs, and other tubulointerstitial diseases including, but not limited to, urate nephropathy, hypercalcemia and nephrocalcinosis, and multiple myeloma; diseases of blood vessels including benign nephrosclerosis, malignant hypertension and accelerated nephrosclerosis, renal artery stenosis, and thrombotic microangiopathies including, but not limited to, classic (childhood) hemolytic-uremic syndrome, adult hemolytic-uremic syndrome/thrombotic thrombocytopenic purpura, idiopathic HUS/TTP, and other vascular disorders including, but not limited to, atherosclerotic ischemic renal disease, atheroembolic renal disease, sickle cell disease nephropathy, diffuse cortical necrosis, and renal infarcts; urinary tract obstruction (obstructive uropathy); urolithiasis (renal calculi, stones); and tumors of the kidney including, but not limited to, benign tumors, such as renal papillary adenoma, renal fibroma or hamartoma (renomedullary interstitial cell tumor), angiomyolipoma, and oncocytoma, and malignant tumors, including renal cell carcinoma (hypernephroma, adenocarcinoma of kidney), which includes urothelial carcinomas of renal pelvis.

Examples of disorders of the lung include, but are not limited to, congenital anomalies; atelectasis; diseases of vascular origin, such as pulmonary congestion and edema, including hemodynamic pulmonary edema and edema caused by microvascular injury, adult respiratory distress syndrome (diffuse alveolar damage), pulmonary embolism, hemorrhage, and infarction, and pulmonary hypertension and vascular sclerosis; chronic obstructive pulmonary disease, such as emphysema, chronic bronchitis, bronchial asthma, and bronchiectasis; diffuse interstitial (infiltrative, restrictive) diseases, such as pneumoconioses, sarcoidosis, idiopathic pulmonary fibrosis, desquamative interstitial pneumonitis, hypersensitivity pneumonitis, pulmonary eosinophilia (pulmonary infiltration with eosinophilia), *Bronchiolitis obliterans*-organizing pneumonia, diffuse pulmonary hemorrhage syndromes, including Goodpasture syndrome, idiopathic pulmonary hemosiderosis and other hemorrhagic syndromes, pulmonary involvement in collagen vascular disorders, and pulmonary alveolar proteinosis; complications of therapies, such as drug-induced lung disease, radiation-induced lung disease, and lung transplantation; tumors, such as bronchogenic carcinoma, including paraneoplastic syndromes, bronchioloalveolar carcinoma, neuroendocrine tumors, such as bronchial carcinoid, miscellaneous tumors, and metastatic tumors; pathologies of the pleura, including inflammatory pleural effusions, noninflammatory pleural effusions, pneumothorax, and pleural tumors, including solitary fibrous tumors (pleural fibroma) and malignant mesothelioma.

As used herein, disorders involving the pancreas include those of the exocrine pancreas such as congenital anomalies, including but not limited to, ectopic pancreas; pancreatitis, including but not limited to, acute pancreatitis; cysts, including but not limited to, pseudocysts; tumors, including but not limited to, cystic tumors and carcinoma of the pancreas; and disorders of the endocrine pancreas such as, diabetes mellitus; islet cell tumors, including but not limited to, insulinomas, gastrinomas, and other rare islet cell tumors.

As used herein, disorders involving the ovary include, for example, polycystic ovarian disease, Stein-leventhal syndrome, Pseudomyxoma peritonei and stromal hyperthecosis; ovarian tumors such as, tumors of coelomic epithelium, serous tumors, mucinous tumors, endometeriod tumors, clear cell adenocarcinoma, cystadenofibroma, brenner tumor, surface epithelial tumors; germ cell tumors such as mature (benign) teratomas, monodermal teratomas, immature malignant teratomas, dysgerminoma, endodermal sinus tumor, choriocarcinoma; sex cord-stomal tumors such as, granulosa-theca cell tumors, thecoma-fibromas, androblastomas, hill cell tumors, and gonadoblastoma; and metastatic tumors such as Krukenberg tumors.

As used herein, hormonal disorders and diseases include type I and type II diabetes mellitus, pituitary disorders (e.g., growth disorders), thyroid disorders (e.g., hypothyroidism or hyperthyroidism), and reproductive or fertility disorders (e.g., disorders which affect the organs of the reproductive system, e.g., the prostate gland, the uterus, or the vagina; disorders which involve an imbalance in the levels of a reproductive hormone in a subject; disorders affecting the ability of a subject to reproduce; and disorders affecting secondary sex characteristic development, e.g., adrenal hyperplasia).

Aberrant expression and/or activity of the molecules of the invention can mediate disorders associated with bone metabolism. "Bone metabolism" refers to direct or indirect effects in the formation or degeneration of bone structures, e.g., bone formation, bone resorption, etc., which can ultimately affect the concentrations in serum of calcium and phosphate. This term also includes activities mediated by the molecules of the invention in bone cells, e.g. osteoclasts and osteoblasts, that can in turn result in bone formation and degeneration. For example, molecules of the invention can support different activities of bone resorbing osteoclasts such as the stimulation of differentiation of monocytes and mononuclear phagocytes into osteoclasts. Accordingly, molecules of the invention that modulate the production of bone cells can influence bone formation and degeneration, and thus can be used to treat bone disorders. Examples of such disorders include, but are not limited to, osteoporosis, osteodystrophy, osteomalacia, rickets, osteitis fibrosa cystica, renal osteodystrophy, osteosclerosis, anti-convulsant treatment, osteopenia, fibrogenesis-imperfecta ossium, secondary hyperparathyroidism, hypoparathyroidism, hyperparathyroidism, cirrhosis, obstructive jaundice, drug induced metabolism, medullary carcinoma, chronic renal disease, rickets, sarcoidosis, glucocorticoid antagonism, malabsorption syndrome, steatorrhea, tropical sprue, idiopathic hypercalcemia and milk fever.

As used herein, "a prostate disorder" refers to an abnormal condition occurring in the male pelvic region characterized by, e.g., male sexual dysfunction and/or urinary symptoms. This disorder may be manifested in the form of genitourinary inflammation (e.g., inflammation of smooth muscle cells) as in several common diseases of the prostate including prostatitis, benign prostatic hyperplasia and cancer, e.g., adenocarcinoma or carcinoma, of the prostate.

Examples of immune, e.g., inflammatory, (e.g. respiratory inflammatory) disorders or diseases include, but are not limited to, autoimmune diseases (including, for example, diabetes mellitus, arthritis (including rheumatoid arthritis, juvenile rheumatoid arthritis, osteoarthritis, psoriatic arthritis), multiple sclerosis, encephalomyelitis, myasthenia gravis, systemic lupus erythematosis, autoimmune thyroiditis, dermatitis (including atopic dermatitis and eczematous dermatitis), psoriasis, Sjögren's Syndrome, inflammatory bowel disease, e.g. Crohn's disease and ulcerative colitis, aphthous ulcer, iritis, conjunctivitis, keratoconjunctivitis, asthma, allergic asthma, chronic obstructive pulmonary disease, cutaneous lupus erythematosus, scieroderma, vaginitis, proctitis, drug eruptions, leprosy reversal reactions, erythema nodosum leprosum, autoimmune uveitis, allergic encephalomyelitis, acute necrotizing hemorrhagic encephalopathy, idiopathic bilateral progressive sensorineural hearing loss, aplastic anemia, pure red cell anemia, idiopathic thrombocytopenia, polychondritis, Wegener's granulomatosis, chronic active hepatitis, Stevens-Johnson syndrome, idiopathic sprue, lichen planus, Graves' disease, sarcoidosis, primary biliary cirrhosis, uveitis posterior, and interstitial lung fibrosis), graft-versus-host disease, cases of transplantation, and allergy such as, atopic allergy.

As used herein, disorders involving the heart, or "cardiovascular disease" or a "cardiovascular disorder" includes a disease or disorder which affects the cardiovascular system, e.g., the heart, the blood vessels, and/or the blood. A cardiovascular disorder can be caused by an imbalance in arterial pressure, a malfunction of the heart, or an occlusion of a blood vessel, e.g., by a thrombus. A cardiovascular disorder includes, but is not limited to disorders such as arteriosclerosis, atherosclerosis, cardiac hypertrophy, ischemia reperfusion injury, restenosis, arterial inflammation, vascular wall remodeling, ventricular remodeling, rapid ventricular pacing, coronary microembolism, tachycardia, bradycardia, pressure overload, aortic bending, coronary artery ligation, vascular heart disease, valvular disease, including but not limited to, valvular degeneration caused by calcification, rheumatic heart disease, endocarditis, or complications of artificial valves; atrial fibrillation, long-QT syndrome, congestive heart failure, sinus node dysfunction, angina, heart failure, hypertension, atrial fibrillation, atrial flutter, pericardial disease, including but not limited to, pericardial effusion and pericarditis; cardiomyopathies, e.g., dilated cardiomyopathy or idiopathic cardiomyopathy, myocardial infarction, coronary artery disease, coronary artery spasm, ischemic disease, arrhythmia, sudden cardiac death, and cardiovascular developmental disorders (e.g., arteriovenous malformations, arteriovenous fistulae, raynaud's syndrome, neurogenic thoracic outlet syndrome, causalgia/reflex sympathetic dystrophy, hemangioma, aneurysm, cavernous angioma, aortic valve stenosis, atrial septal defects, atrioventricular canal, coarctation of the aorta, ebsteins anomaly, hypoplastic left heart syndrome, interruption of the aortic arch, mitral valve prolapse, ductus arteriosus, patent foramen ovale, partial anomalous pulmonary venous return, pulmonary atresia with ventricular septal defect, pulmonary atresia without ventricular septal defect, persistance of the fetal circulation, pulmonary valve stenosis, single ventricle, total anomalous pulmonary venous return, transposition of the great vessels, tricuspid atresia, truncus arteriosus, ventricular septal defects). A cardiovascular disease or disorder also can include an endothelial cell disorder.

"Procedural vascular trauma" includes the effects of surgical/medical-mechanical interventions into mammalian vasculature, but does not include vascular trauma due to the organic vascular pathologies listed hereinabove, or to unintended traumas, such as-due to an accident. Thus, procedural vascular traumas within the scope of the present treatment method include (1) organ grafting or transplantation, such as transplantation and grafting of heart, kidney, liver and the like, e.g., involving vessel anastomosis; (2) vascular surgery, such as coronary bypass surgery, biopsy, heart valve replacement, atheroectomy, thrombectomy, and the like; (3) transcatheter vascular therapies (TVT) including angioplasty, e.g., laser angioplasty and PTCA procedures discussed hereinbelow, employing balloon catheters, or indwelling catheters; (4) vascular grafting using natural or synthetic materials, such as in saphenous vein coronary bypass grafts, dacron and venous grafts used for peripheral arterial reconstruction, etc.; (5) placement of a mechanical shunt, such as a PTFE hemodialysis shunt used for arteriovenous communications; and (6) placement of an intravascular stent, which may be metallic, plastic or a biodegradable polymer. See U.S. patent application Ser. No. 08/389,712, filed Feb. 15, 1995, which is incorporated by reference herein. For a general discussion of implantable devices and biomaterials from which they can be formed, see H. Kambic et al., "Biomaterials in Artificial Organs", Chem. Eng. News, 30 (Apr. 14, 1986), the disclosure of which is incorporated by reference herein.

Small vessel disease includes, but is not limited to, vascular insufficiency in the limbs, peripheral neuropathy and retinopathy, e.g., diabetic retinopathy.

As used herein, disorders involving the brain include, but are not limited to, disorders involving neurons, and disorders involving glia, such as astrocytes, oligodendrocytes, ependymal cells, and microglia; cerebral edema, raised intracranial pressure and herniation, and hydrocephalus; malformations and developmental diseases, such as neural tube defects, forebrain anomalies, posterior fossa anomalies, and syringomyelia and hydromyelia; perinatal brain injury; cerebrovascular diseases, such as those related to hypoxia, ischemia, and infarction, including hypotension, hypoperfusion, and low-flow states—global cerebral ischemia and focal cerebral ischemia—infarction from obstruction of local blood supply, intracranial hemorrhage, including intracerebral (intraparenchymal) hemorrhage, subarachnoid hemorrhage and ruptured berry aneurysms, and vascular malformations, hypertensive cerebrovascular disease, including lacunar infarcts, slit hemorrhages, and hypertensive encephalopathy; infections, such as acute meningitis, including acute pyogenic (bacterial) meningitis and acute aseptic (viral) meningitis, acute focal suppurative infections, including brain abscess, subdural empyema, and extradural abscess, chronic bacterial meningoencephalitis, including tuberculosis and mycobacterioses, neurosyphilis, and neuroborreliosis (Lyme disease), viral meningoencephalitis, including arthropod-borne (Arbo) viral encephalitis, Herpes simplex virus Type 1, Herpes simplex virus Type 2, Varicella-zoster virus (*Herpes zoster*), cytomegalovirus, poliomyelitis, rabies, and human immunodeficiency virus 1, including HIV-1 meningoencephalitis (subacute encephalitis), vacuolar myelopathy, AIDS-associated myopathy, peripheral neuropathy, and AIDS in children, progressive multifocal leukoencephalopathy, subacute sclerosing panencephalitis, fungal meningoencephalitis, other infectious diseases of the nervous system; transmissible spongiform encephalopathies (prion diseases); demyelinating diseases, including multiple sclerosis, multiple sclerosis variants, acute disseminated encephalomyelitis and acute necrotizing hemorrhagic encephalomyelitis, and other diseases with demyelination; degenerative diseases, such as degenerative diseases affecting the cerebral cortex, including Alzheimer disease and Pick disease, degenerative diseases of basal ganglia and brain stem, including Parkinsonism, idiopathic Parkinson disease (paralysis agitans), progressive supranuclear palsy, corticobasal degenration, multiple system atrophy, including striatonigral degenration, Shy-Drager syndrome, and olivopontocerebellar atrophy, and Huntington disease; spinocerebellar degenerations, including spinocerebellar ataxias, including Friedreich ataxia, and ataxia-telanglectasia, degenerative diseases affecting motor neurons, including amyotrophic lateral sclerosis (motor neuron disease), bulbospinal atrophy (Kennedy syndrome), and spinal muscular atrophy; inborn errors of metabolism, such as leukodystrophies, including Krabbe disease, metachromatic leukodystrophy, adrenoleukodystrophy, Pelizaeus-Merzbacher disease, and Canavan disease, mitochondrial encephalomyopathies, including Leigh disease and other mitochondrial encephalomyopathies; toxic and acquired metabolic diseases, including vitamin deficiencies such as thiamine (vitamin $B_1$) deficiency and vitamin $B_{12}$ deficiency, neurologic sequelae of metabolic disturbances, including hypoglycemia, hyperglycemia, and hepatic encephatopathy, toxic disorders, including carbon monoxide, methanol, ethanol, and radiation, including combined methotrexate and radiation-induced injury; tumors, such as gliomas, including astrocytoma, including fibrillary (diffuse) astrocytoma and glioblastoma multiforme, pilocytic astrocytoma, pleomorphic xanthoastrocytoma, and brain stem glioma, oligodendroglioma, and ependymoma and related paraventricular mass lesions, neuronal tumors, poorly differentiated neoplasms, including medulloblastoma, other parenchymal tumors, including primary brain lymphoma, germ cell tumors, and pineal parenchymal tumors, meningiomas, metastatic tumors, paraneoplastic syndromes, peripheral nerve sheath tumors, including schwannoma, neurofibroma, and malignant peripheral nerve sheath tumor (malignant schwannoma), and neurocutaneous syndromes (phakomatoses), including neurofibromotosis, including Type 1 neurofibromatosis (NF1) and TYPE 2 neurofibromatosis (NF2), tuberous sclerosis, and Von Hippel-Lindau disease.

As used herein, disorders involving blood vessels include, but are not limited to, responses of vascular cell walls to injury, such as endothelial dysfunction and endothelial activation and intimal thickening; vascular diseases including, but not limited to, congenital anomalies, such as arteriovenous fistula, atherosclerosis, and hypertensive vascular disease, such as hypertension; inflammatory disease—the vasculitides, such as giant cell (temporal) arteritis, Takayasu arteritis, polyarteritis nodosa (classic), Kawasaki syndrome (mucocutaneous lymph node syndrome), microscopic polyanglitis (microscopic polyarteritis, hypersensitivity or leukocytoclastic anglitis), Wegener granulomatosis, thromboanglitis obliterans (Buerger disease), vasculitis associated with other disorders, and infectious arteritis; Raynaud disease; aneurysms and dissection, such as abdominal aortic aneurysms, syphilitic (luetic) aneurysms, and aortic dissection (dissecting hematoma); disorders of veins and lymphatics, such as varicose veins, thrombophlebitis and phlebothrombosis, obstruction of superior vena cava (superior vena cava syndrome), obstruction of inferior vena cava (inferior vena cava syndrome), and lymphangitis and lymphedema; tumors, including benign tumors and tumor-like conditions, such as hemangioma, lymphangioma, glomus tumor (glomangioma), vascular ectasias, and bacillary angiomatosis, and intermediate-grade (borderline low-grade malignant) tumors, such as Kaposi sarcoma and hemangloendothelioma, and malignant tumors, such as angiosarcoma and hemangiopericytoma; and pathology of therapeutic interventions in vascular disease, such as balloon angioplasty and related techniques and vascular replacement, such as coronary artery bypass graft surgery.

As used herein, disorders involving the testis and epididymis include, but are not limited to, congenital anomalies such as cryptorchidism, regressive changes such as atrophy, inflammations such as nonspecific epididymitis and orchitis, granulomatous (autoimmune) orchitis, and specific inflammations including, but not limited to, gonorrhea, mumps, tuberculosis, and syphilis, vascular disturbances including torsion, testicular tumors including germ cell tumors that include, but are not limited to, seminoma, spermatocytic seminoma, embryonal carcinoma, yolk sac tumor choriocarcinoma, teratoma, and mixed tumors, tumore of sex cord-gonadal stroma including, but not limited to, Leydig (interstitial) cell tumors and sertoli cell tumors (androblastoma), and testicular lymphoma, and miscellaneous lesions of tunica vaginalis.

As used herein, skeletal muscle disorders include, but are not limited to, muscular dystrophy (e.g., Duchenne muscular dystrophy, Becker muscular dystrophy, Emery-Dreifuss muscular dystrophy, limb-girdle muscular dystrophy, facioscapulohumeral muscular dystrophy, myotonic dystrophy, oculopharyngeal muscular dystrophy, distal muscular dystrophy, and congenital muscular dystrophy), motor neuron diseases (e.g., amyotrophic lateral sclerosis, infantile progressive spinal muscular atrophy, intermediate spinal muscular atrophy, spinal bulbar muscular atrophy, and adult spinal muscular atrophy), myopathies (e.g., inflammatory myopathies (e.g., dermatomyositis and polymyositis), myotonia congenita, paramyotonia congenita, central core disease, nemaline myopathy, myotubular myopathy, and periodic paralysis), tumors such as rhabdomyosarcoma, and metabolic diseases of muscle (e.g., phosphorylase deficiency, acid maltase deficiency, phosphofructokinase deficiency, debrancher enzyme deficiency, mitochondrial myopathy, carnitine deficiency, carnitine palmityl transferase deficiency, phosphoglycerate kinase deficiency, phosphoglycerate mutase deficiency, lactate dehydrogenase deficiency, and myoadenylate deaminase deficiency).

As used herein, an "endothelial cell disorder" includes a disorder characterized by aberrant, unregulated, or unwanted endothelial cell activity, e.g., proliferation, migration, angiogenesis, or vascularization; or aberrant expression of cell surface adhesion molecules or genes associated with angiogenesis, e.g., TIE-2, FLT and FLK. Endothelial cell disorders include tumorigenesis, tumor metastasis, psoriasis, diabetic retinopathy, endometriosis, Grave's disease, ischemic disease (e.g., atherosclerosis), and chronic inflammatory diseases (e.g., rheumatoid arthritis).

Disorders which can be treated or diagnosed by methods described herein include, but are not limited to, disorders associated with an accumulation in the liver of fibrous tissue, such as that resulting from an imbalance between production and degradation of the extracellular matrix accompanied by the collapse and condensation of preexisting fibers. The methods described herein can be used to diagnose or treat hepatocellular necrosis or injury induced by a wide variety of agents including processes which disturb homeostasis, such as an inflammatory process, tissue damage resulting from toxic injury or altered hepatic blood flow, and infections (e.g., bacterial, viral and parasitic). For example, the methods can be used for the early detection of hepatic injury, such as portal hypertension or hepatic fibrosis. In addition, the methods can be employed to detect liver fibrosis attributed to inborn errors of metabolism, for example, fibrosis resulting from a storage disorder such as Gaucher's disease (lipid abnormalities) or a glycogen storage disease, A1-antitrypsin deficiency; a disorder mediating the accumulation (e.g., storage) of an exogenous substance, for example, hemochromatosis (iron-overload syndrome) and copper storage diseases (Wilson's disease), disorders resulting in the accumulation of a toxic metabolite (e.g., tyrosinemia, fructosemia and galactosemia) and peroxisomal disorders (e.g., Zellweger syndrome). Additionally, the methods described herein can be used for the early detection and treatment of liver injury associated with the administration of various chemicals or drugs, such as for example, methotrexate, isonizaid, oxyphenisatin, methyldopa, chlorpromazine, tolbutamide or alcohol, or which represents a hepatic manifestation of a vascular disorder such as obstruction of either the intrahepatic or extrahepatic bile flow or an alteration in hepatic circulation resulting, for example, from chronic heart failure, veno-occlusive disease, portal vein thrombosis or Budd-Chiari syndrome.

Additionally, the molecules of the invention can play an important role in the etiology of certain viral diseases, including but not limited to Hepatitis B, Hepatitis C and Herpes Simplex Virus (HSV). Modulators of the activity of the molecules of the invention could be used to control viral diseases. The modulators can be used in the treatment and/or diagnosis of viral infected tissue or virus-associated tissue fibrosis, especially liver and liver fibrosis. Also, such modulators can be used in the treatment and/or diagnosis of virus-associated carcinoma, especially hepatocellular cancer.

Disorders related to reduced platelet number, thrombocytopenia, include idiopathic thrombocytopenic purpura, including acute idiopathic thrombocytopenic purpura, drug-induced thrombocytopenia, HIV-associated thrombocytopenia, and thrombotic microangiopathies: thrombotic thrombocytopenic purpura and hemolytic-uremic syndrome.

As used herein, neurological disorders include disorders of the central nervous system (CNS) and the peripheral nervous system, e.g., cognitive and neurodegenerative disorders, Examples of neurological disorders include, but are not limited to, autonomic function disorders such as hypertension and sleep disorders, and neuropsychiatric disorders, such as depression, schizophrenia, schizoaffective disorder; Korsakoff's psychosis, alcoholism, anxiety disorders, or phobic disorders; learning or memory disorders, e.g., amnesia or age-related memory loss, attention deficit disorder, dysthymic disorder, major depressive disorder, mania, obsessive-compulsive disorder, psychoactive substance use disorders, anxiety, phobias, panic disorder, as well as bipolar affective disorder, e.g., severe bipolar affective (mood) disorder (BP-1), and bipolar affective neurological disorders, e.g., migraine and obesity. Such neurological disorders include, for example, disorders involving neurons, and disorders involving glia, such as astrocytes, oligodendrocytes, ependymal cells, and microglia; cerebral edema, raised intracranial pressure and herniation, and hydrocephalus; malformations and developmental diseases, such as neural tube defects, forebrain anomalies, posterior fossa anomalies, and syringomyelia and hydromyelia; perinatal brain injury; cerebrovascular diseases, such as those related to hypoxia, ischemia, and infarction, including hypotension, hypoperfusion, and low-flow states—global cerebral ischemia and focal cerebral ischemia—infarction from obstruction of local blood supply, intracranial hemorrhage, including intracerebral (intraparenchymal) hemorrhage, subarachnoid hemorrhage and ruptured berry aneurysms, and vascular malformations, hypertensive cerebrovascular disease, including lacunar infarcts, slit hemorrhages, and hypertensive encephalopathy; infections, such as acute meningitis, including acute pyogenic (bacterial) meningitis and acute aseptic (viral) meningitis, acute focal suppurative infections, including brain abscess, subdural empyema, and extradural abscess, chronic bacterial meningoencephalitis, including tuberculosis and mycobacterioses, neurosyphilis, and neuroborreliosis (Lyme disease), viral meningoencephalitis, including arthropod-borne (Arbo) viral encephalitis, Herpes simplex virus Type 1, Herpes simplex virus Type 2, Varicella-zoster virus (*Herpes zoster*), cytomegalovirus, poliomyelitis, rabies, and human immunodeficiency virus 1, including HIV-1 meningoencephalitis (subacute encephalitis), vacuolar myelopathy, AIDS-associated myopathy, peripheral neuropathy, and AIDS in children, progressive multifocal leukoencephalopathy, subacute sclerosing panencephalitis, fungal meningoencephalitis, other infectious diseases of the nervous system; transmissible spongiform encephalopathies (prion diseases); demyelinating diseases, including multiple sclerosis, multiple sclerosis variants, acute disseminated encephalomyelitis and acute necrotizing hemorrhagic encephalomyelitis, and other diseases with demyelination; degenerative diseases, such as degenerative diseases affecting the cerebral cortex, including Alzheimer's disease and Pick's disease, degenerative diseases of basal ganglia and brain stem, including Parkinsonism, idiopathic Parkinson's disease (paralysis agitans) and other Lewy diffuse body diseases, progressive supranuclear palsy, corticobasal degeneration, multiple system atrophy, including striatonigral degeneration, Shy-Drager syndrome, and olivopontocerebellar atrophy, and Huntington's disease, senile dementia, Gilles de la Tourette's syndrome, epilepsy, and Jakob-Creutzfieldt disease; spinocerebellar degenerations, including spinocerebellar ataxias, including Friedreich ataxia, and ataxia-telanglectasia, degenerative diseases affecting motor neurons, including amyotrophic lateral sclerosis (motor neuron disease), bulbospinal atrophy (Kennedy syndrome), and spinal muscular atrophy; inborn errors of metabolism, such as leukodystrophies, including Krabbe disease, metachromatic leukodystrophy, adrenoleukodystrophy, Pelizaeus-Merzbacher disease, and Canavan disease, mitochondrial encephalomyopathies, including Leigh disease and other mitochondrial encephalomyopathies; toxic and acquired metabolic diseases, including vitamin deficiencies such as thiamine (vitamin $B_1$) deficiency and vitamin $B_{12}$ deficiency, neurologic sequelae of metabolic disturbances, including hypoglycemia, hyperglycemia, and hepatic encephalopathy, toxic disorders, including carbon monoxide, methanol, ethanol, and radiation, including combined methotrexate and radiation-induced injury; tumors, such as gliomas, including astrocytoma, including fibrillary (diffuse) astrocytoma and glioblastoma multiforme, pilocytic astrocytoma, pleomorphic xanthoastrocytoma, and brain stem glioma, oligodendroglioma, and ependymoma and related paraventricular mass lesions, neuronal tumors, poorly differentiated neoplasms, including medulloblastoma, other parenchymal tumors, including primary brain lymphoma, germ cell tumors, and pineal parenchymal tumors, meningiomas, metastatic tumors, paraneoplastic syndromes, peripheral nerve sheath tumors, including schwannoma, neurofibroma, and malignant peripheral nerve sheath tumor (malignant schwannoma), and neurocutaneous syndromes (phakomatoses), including neurofibromotosis, including Type 1 neurofibromatosis (NF1) and TYPE 2 neurofibromatosis (NF2), tuberous sclerosis, and Von Hippel-Lindau disease. Further CNS-related disorders include, for example, those listed in the American Psychiatric Association's Diagnostic and Statistical manual of Mental Disorders (DSM), the most current version of which is incorporated herein by reference in its entirety.

As used herein, diseases of the skin, include but are not limited to, disorders of pigmentation and melanocytes, including but not limited to, vitiligo, freckle, melasma, lentigo, nevocellular nevus, dysplastic nevi, and malignant melanoma; benign epithelial tumors, including but not limited to, seborrheic keratoses, acanthosis nigricans, fibroepithelial polyp, epithelial cyst, keratoacanthoma, and adnexal (appendage) tumors; premalignant and malignant epidermal tumors, including but not limited to, actinic keratosis, squamous cell carcinoma, basal cell carcinoma, and merkel cell carcinoma; tumors of the dermis, including but not limited to, benign fibrous histiocytoma, dermatofibrosarcoma protuberans, xanthomas, and dermal vascular tumors; tumors of cellular immigrants to the skin, including but not limited to, histiocytosis X, mycosis fungoides (cutaneous T-cell lymphoma), and mastocytosis; disorders of epidermal maturation, including but not limited to, ichthyosis; acute inflammatory dermatoses, including but not limited to, urticaria, acute eczematous dermatitis, and erythema multiforme; chronic inflammatory dermatoses, including but not limited to, psoriasis, lichen planus, and lupus erythematosus; blistering (bullous) diseases, including but not limited to, pemphigus, bullous pemphigoid, dermatitis herpetiformis, and noninflammatory blistering diseases: epidermolysis bullosa and porphyria; disorders of epidermal appendages, including but not limited to, acne vulgaris; panniculitis, including but not limited to, erythema nodosum and erythema induratum; and infection and infestation, such as verrucae, molluscum contagiosum, impetigo, superficial fungal infections, and arthropod bites, stings, and infestations.

As used herein, disorders involving the eye and vision include, but are not limited to, granulomatous uveitis, cataracts, trachoma, corneal dystrophies, e.g., granular dystrophy or lattice dystrophy, glaucomas, retrolental fibroplasia, diabetes mellitus, hypertensive and arteriosclerotic retinopathy, retinitis pigmentosa, macular degeneration, retinoblastoma, papillaedema, and optic neuritis.

Additionally, molecules of the invention can play an important role in the regulation of metabolism or pain disorders. Diseases of metabolic imbalance include, but are not limited to, obesity, anorexia nervosa, cachexia, lipid disorders, and diabetes. Examples of pain disorders include, but are not limited to, pain response elicited during various forms of tissue injury, e.g., inflammation, infection, and ischemia, usually referred to as hyperalgesia (described in, for example, Fields (1987) *Pain*, New York:McGraw-Hill); pain associated with musculoskeletal disorders, e.g., joint pain; tooth pain; headaches; pain associated with surgery; pain related to irritable bowel syndrome; or chest pain.

Various aspects of the invention are described in further detail below.

Isolated Nucleic Acid Molecules

In one aspect, the invention provides, an isolated or purified, nucleic acid molecule that encodes a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptide described herein, e.g., a full length 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein or a fragment thereof, e.g., a biologically active portion of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein. Also included is a nucleic acid fragment suitable for use as a hybridization probe, which can be used, e.g., to identify a nucleic acid molecule encoding a polypeptide of the invention, 13237, 18480, 2245, 16228, 7677, 26320, 46619, 33166, 16836, 46867, 21617, 55562, 39228, 62088, 46745, 23155, 21657, 42755, 32229, 22325, 46863 or 32252 mRNA, and fragments suitable for use as primers, e.g., PCR primers for the amplification or mutation of nucleic acid molecules.

In one embodiment, an isolated nucleic acid molecule of the invention includes the nucleotide sequence shown in SEQ ID NO:1, 3, 4, 6, 7, 9, 10, 12, 39, 41, 54, 56, 58, 59, 61, 63, 65, 66, 68, 75, 77, 79, 81, 82, 84, 89, 91, 92, 94, 95, 97, 107, 109, 112, 114, 117, 119, 120, 122, 127, 129, 139, 141, 151 or 153, or a portion of any of this nucleotide sequence. In one embodiment, the nucleic acid molecule includes sequences encoding the human 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein (i.e., "the coding region" of SEQ ID NO:1, 4, 7, 10, 39, 54, 59, 63, 66, 75, 79, 82, 89, 92, 95, 107, 112, 117, 120, 127, 139 or 151, as shown in SEQ ID NO:3, 6, 9, 12, 41, 56, 58, 61, 65, 68, 77, 81, 84, 91, 94, 97, 109, 114, 119, 122, 129, 141 or 153, respectively), as well as 5' untranslated sequences and 3' untranslated sequences. Alternatively, the nucleic acid molecule can include only the coding region of SEQ ID NO:1, 4, 7, 10, 39, 54, 59, 63, 66, 75, 79, 82, 89, 92, 95, 107, 112, 117, 120, 127, 139 or 151 (e.g., SEQ ID NO:3, 6, 9, 12, 41, 56, 58, 61, 65, 68, 77, 81, 84, 91, 94, 97, 109, 114, 119, 122, 129, 141 or 153) and, e.g., no flanking sequences which normally accompany the subject sequence. In another embodiment, the nucleic acid molecule encodes a sequence corresponding to a fragment of the protein corresponding to domains within SEQ ID NO:2, 5, 8, 11, 40, 55, 57, 60, 64, 67, 76, 80, 83, 90, 93, 96, 108, 113, 118, 121, 128, 140 or 152.

In another embodiment, an isolated nucleic acid molecule of the invention includes a nucleic acid molecule which is a complement of the nucleotide sequence shown in SEQ ID NO:1, 3, 4, 6, 7, 9, 10, 12, 39, 41, 54, 56, 58, 59, 61, 63, 65, 66, 68, 75, 77, 79, 81, 82, 84, 89, 91, 92, 94, 95, 97, 107, 109, 112, 114, 117, 119, 120, 122, 127, 129, 139, 141, 151 or 153, or a portion of any of these nucleotide sequences. In other embodiments, the nucleic acid molecule of the invention is sufficiently complementary to the nucleotide sequence shown in SEQ ID NO:1, 3, 4, 6, 7, 9, 10, 12, 39, 41, 54, 56, 58, 59, 61, 63, 65, 66, 68, 75, 77, 79, 81, 82, 84, 89, 91, 92, 94, 95, 97, 107, 109, 112, 114, 117, 119, 120, 122, 127, 129, 139, 141, 151 or 153 such that it can hybridize to the nucleotide sequence shown in SEQ ID NO:1, 3, 4, 6, 7, 9, 10, 12, 39, 41, 54, 56, 58, 59, 61, 63, 65, 66, 68, 75, 77, 79, 81, 82, 84, 89, 91, 92, 94, 95, 97, 107, 109, 112, 114, 117, 119, 120, 122, 127, 129, 139, 141, 151 or 153, thereby forming a stable duplex.

In one embodiment, an isolated nucleic acid molecule of the present invention includes a nucleotide sequence which is at least about: 60%, 65%, 70%, 75%, 80%, 85%, 90%, 91%, 92%, 93%, 94%, 95%, 96%, 97%, 98%, 99%, or more homologous to the entire length of the nucleotide sequence shown in SEQ ID NO:1, 3, 4, 6, 7, 9, 10, 12, 39, 41, 54, 56, 58, 59, 61, 63, 65, 66, 68, 75, 77, 79, 81, 82, 84, 89, 91, 92, 94, 95, 97, 107, 109, 112, 114, 117, 119, 120, 122, 127, 129, 139, 141, 151 or 153, or a portion, preferably of the same length, of any of these nucleotide sequences.

13237, 18480, 2245, 16228, 7677, 26320, 46619, 33166, 16836, 46867, 21617, 55562, 39228, 62088, 46745, 23155, 21657, 42755, 32229, 22325.46863 or 32252 Nucleic Acid Fragments A nucleic acid molecule of the invention can include only a portion of the nucleic acid sequence of SEQ ID NO:1, 3, 4, 6, 7, 9, 10, 12, 39, 41, 54, 56, 58, 59, 61, 63, 65, 66, 68, 75, 77, 79, 81, 82, 84, 89, 91, 92, 94, 95, 97, 107, 109, 112, 114, 117, 119, 120, 122, 127, 129, 139, 141, 151 or 153. For example, such a nucleic acid molecule can include a fragment which can be used as a probe or primer or a fragment encoding a portion of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein, e.g., an immunogenic or biologically active portion of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein. A fragment can comprise those nucleotides of SEQ ID NO: 1, 3, 4, 6, 7, 9, 10, 12, 39, 41, 54, 56, 58, 59, 61, 63, 65, 66, 68, 75, 77, 79, 81, 82, 84, 89, 91, 92, 94, 95, 97, 107, 109, 112, 114, 117, 119, 120, 122, 127, 129, 139, 141, 151 or 153, which encode a domain of human 13237, 18480, 2245, 16228, 7677, 26320, 46619, 33166, 16836, 46867, 21617, 55562, 39228, 62088, 46745, 23155, 21657, 42755, 32229, 22325, 46863 or 32252. The nucleotide sequence determined from the cloning of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene allows for the generation of probes and primers designed for use in identifying and/or cloning other 13237, 18480, 2245, 16228, 7677, 26320, 46619, 33166, 16836, 46867, 21617, 55562, 39228, 62088, 46745, 23155, 21657, 42755, 32229, 22325, 46863 or 32252 family members, or fragments thereof, as well as 13237, 18480, 2245, 16228, 7677, 26320, 46619, 33166, 16836, 46867, 21617, 55562, 39228, 62088, 46745, 23155, 21657, 42755, 32229, 22325, 46863 or 32252 homologs, or fragments thereof, from other species.

In another embodiment, a nucleic acid includes a nucleotide sequence that includes part, or all, of the coding region and extends into either (or both) the 5' or 3' noncoding region. Other embodiments include a fragment which includes a nucleotide sequence encoding an amino acid fragment described herein. Nucleic acid fragments can encode a specific domain or site described herein or fragments thereof, particularly fragments thereof which are at least 100 amino acids in length. Fragments also include nucleic acid sequences corresponding to specific amino acid sequences described above or fragments thereof. Nucleic acid fragments should not to be construed as encompassing those fragments that may have been disclosed prior to the invention.

A nucleic acid fragment can include a sequence corresponding to a domain, region, or functional site described herein. A nucleic acid fragment can also include one or more domain, region, or functional site described herein. Thus, for example, a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 nucleic acid fragment can include a sequence corresponding to a domain, as described herein.

13237, 18480, 2245, 16228, 7677, 26320, 46619, 33166, 16836, 46867, 21617, 55562, 39228, 62088, 46745, 23155, 21657, 42755, 32229, 22325, 46863 or 32252 probes and primers are provided. Typically a probe/primer is an isolated or purified oligonucleotide. The oligonucleotide typically includes a region of nucleotide sequence that hybridizes under stringent conditions to at least about 7, 12 or 15, preferably about 20 or 25, more preferably about 30, 35, 40, 45, 50, 55, 60, 65, or 75 consecutive nucleotides of a sense or antisense sequence of SEQ ID NO:1, 3, 4, 6, 7, 9, 10, 12, 39, 41, 54, 56, 58, 59, 61, 63, 65, 66, 68, 75, 77, 79, 81, 82, 84, 89, 91, 92, 94, 95, 97, 107, 109, 112, 114, 117, 119, 120, 122, 127, 129, 139, 141, 151 or 153, or of a naturally occurring allelic variant or mutant of SEQ ID NO:1, 3, 4, 6, 7, 9, 10, 12, 39, 41, 54, 56, 58, 59, 61, 63, 65, 66, 68, 75, 77, 79, 81, 82, 84, 89, 91, 92, 94, 95, 97, 107, 109, 112, 114, 117, 119, 120, 122, 127, 129, 139, 141, 151 or 153.

In a preferred embodiment the nucleic acid is a probe which is at least 5 or 10, and less than 200, more preferably less than 100, or less than 50, base pairs in length. It should be identical, or differ by 1, or less than in 5 or 10 bases, from a sequence disclosed herein. If alignment is needed for this comparison the sequences should be aligned for maximum homology. "Looped" out sequences from deletions or insertions, or mismatches, are considered differences.

A probe or primer can be derived from the sense or antisense strand of a nucleic acid which encodes a domain identified in the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 sequences.

In another embodiment a set of primers is provided, e.g., primers suitable for use in a PCR, which can be used to amplify a selected region of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 sequence, e.g., a domain, region, site or other sequence described herein. The primers should be at least 5, 10, or 50 base pairs in length and less than 100, or less than 200, base pairs in length. The primers should be identical, or differ by one base from a sequence disclosed herein or from a naturally occurring variant.

A nucleic acid fragment can encode an epitope bearing region of a polypeptide described herein.

A nucleic acid fragment encoding a "biologically active portion of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptide" can be prepared by isolating a portion of the nucleotide sequence of SEQ ID NO:1, 3, 4, 6, 7, 9, 10, 12, 39, 41, 54, 56, 58, 59, 61, 63, 65, 66, 68, 75, 77, 79, 81, 82, 84, 89, 91, 92, 94, 95, 97, 107, 109, 112, 114, 117, 119, 120, 122, 127, 129, 139, 141, 151 or 153, which encodes a polypeptide having a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 biological activity (e.g., the biological activities of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 proteins are described herein), expressing the encoded portion of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein (e.g., by recombinant expression in vitro) and assessing the activity of the encoded portion of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein. A nucleic acid fragment encoding a biologically active portion of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptide, can comprise a nucleotide sequence which is greater than 300 or more nucleotides in length.

In preferred embodiments, a nucleic acid includes a nucleotide sequence which is about 300, 400, 500, 600, 700, 800, 900, 1000, 1100, 1200, 1300, 1400, 1500, 1600, 1700, 1800, 1900, 2000, 2100, 2200, 2300, 2400, 2500, 2600, 2700, 2800, 2900, 3000, 3100, 3200, 3300, 3400, 3500, 3600, 3700, 3800, 3900, 4000, 4100, 4200, 4300, 4400, 4500, 4600, 4700, 4800, 4900, 5000, 5100, 5200, 5300, 5400, 5500, 5600, 5700, 5800, 5900, 6000, 6100, 6200, 6300, 6400, 6500, 6600, 6700, 6800, 6900, 7000, 7100, 7200, 7300, 7400, 7500, 7600, 7700, 7800, 7900, 8000, 8100, 8200, 8300, 8400, 8500, 8600, 8700, 8800, 8900, 9000, 9100, 9200, 9300, 9400, 9500, 9600, 9700, 9800, 9900, 10000, 10100, 10200 or more nucleotides in length and hybridizes under stringent hybridization conditions to a nucleic acid molecule of SEQ ID NO:1, 3, 4, 6, 7, 9, 10, 12, 39, 41, 54, 56, 58, 59, 61, 63, 65, 66, 68, 75, 77, 79, 81, 82, 84, 89, 91, 92, 94, 95, 97, 107, 109, 112, 114, 117, 119, 120, 122, 127, 129, 139, 141, 151 or 153.

13237, 18480, 2245, 16228, 7677, 26320, 46619, 33166, 16836, 46867, 21617, 55562, 39228, 62088, 46745, 23155, 21657, 42755, 32229, 22325, 46863 or 32252 Nucleic Acid Variants The invention further encompasses nucleic acid molecules that differ from the nucleotide sequence shown in SEQ ID NO:1, 3, 4, 6, 7, 9, 10, 12, 39, 41, 54, 56, 58, 59, 61, 63, 65, 66, 68, 75, 77, 79, 81, 82, 84, 89, 91, 92, 94, 95, 97, 107, 109, 112, 114, 117, 119, 120, 122, 127, 129, 139, 141, 151 or 153. Such differences can be due to degeneracy of the genetic code (and result in a nucleic acid which encodes the same 13237, 18480, 2245, 16228, 7677, 26320, 46619, 33166, 16836, 46867, 21617, 55562, 39228, 62088, 46745, 23155, 21657, 42755, 32229, 22325, 46863 or 32252 proteins as those encoded by the nucleotide sequence disclosed herein. In another embodiment, an isolated nucleic acid molecule of the invention has a nucleotide sequence encoding a protein having an amino acid sequence which differs, by at least 1, but less than 5, 10, 20, 50, or 100 amino acid residues that shown in SEQ ID NO:2, 5, 8, 11, 40, 55, 57, 60, 64, 67, 76, 80, 83, 90, 93, 96, 108, 113, 118, 121, 128, 140 or 152. If alignment is needed for this comparison the sequences should be aligned for maximum homology. "Looped" out sequences from deletions or insertions, or mismatches, are considered differences.

Nucleic acids of the inventor can be chosen for having codons, which are preferred, or non-preferred, for a particular expression system. E.g., the nucleic acid can be one in which at least one codon, at preferably at least 10%, or 20% of the codons has been altered such that the sequence is optimized for expression in E. coli, yeast, human, insect, or CHO cells.

Nucleic acid variants can be naturally occurring, such as allelic variants (same locus), homologs (different locus), and orthologs (different organism) or can be non naturally occurring. Non-naturally occurring variants can be made by mutagenesis techniques, including those applied to polynucleotides, cells, or organisms. The variants can contain nucleotide substitutions, deletions, inversions and insertions. Variation can occur in either or both the coding and non-coding regions. The variations can produce both conservative and non-conservative amino acid substitutions (as compared in the encoded product).

In a preferred embodiment, the nucleic acid differs from that of SEQ ID NO:1, 3, 4, 6, 7, 9, 10, 12, 39, 41, 54, 56, 58, 59, 61, 63, 65, 66, 68, 75, 77, 79, 81, 82, 84, 89, 91, 92, 94, 95, 97, 107, 109, 112, 114, 117, 119, 120, 122, 127, 129, 139, 141, 151 or 153, e.g., as follows: by at least one but less than 10, 20, 30, or 40 nucleotides; at least one but less than 1%, 5%, 10% or 20% of the nucleotides in the subject nucleic acid. If necessary for this analysis the sequences should be aligned for maximum homology. "Looped" out sequences from deletions or insertions, or mismatches, are considered differences.

Orthologs, homologs, and allelic variants can be identified using methods known in the art. These variants comprise a nucleotide sequence encoding a polypeptide that is 50%, at least about 55%, typically at least about 70-75%, more typically at least about 80-85%, and most typically at least about 90-95% or more identical to the nucleotide sequence shown in SEQ ID NO:2, 5, 8, 11, 40, 55, 57, 60, 64, 67, 76, 80, 83, 90, 93, 96, 108, 113, 118, 121, 128, 140 or 152 or a fragment of this sequence. Such nucleic acid molecules can readily be identified as being able to hybridize under stringent conditions, to the nucleotide sequence shown in SEQ ID NO:2, 5, 8, 11, 40, 55, 57, 60, 64, 67, 76, 80, 83, 90, 93, 96, 108, 113, 118, 121, 128, 140 or 152 or a fragment of the sequence. Nucleic acid molecules corresponding to orthologs, homologs, and allelic variants of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 cDNAs of the invention can further be isolated by mapping to the same chromosome or locus as the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene.

Preferred variants include those that are correlated with activities specific to the molecules of the invention, i.e. protein kinase activity, methyltransferase activity, acyl-CoA dehydrogenase activity, short chain dehyrdogenase activity, reductase activity, acyltransferase activity, phosphatase activity, transferase activity, ATP-ase activity, synthase activity, or other.

Allelic variants of 13237, 18480, 2245, 16228, 7677, 26320, 46619, 33166, 16836, 46867, 21617, 55562, 39228, 62088, 46745, 23155, 21657, 42755, 32229, 22325, 46863 or 32252, e.g., human 13237, 18480, 2245, 16228, 7677, 26320, 46619, 33166, 16836, 46867, 21617, 55562, 39228, 62088, 46745, 23155, 21657, 42755, 32229, 22325, 46863 or 32252, include both functional and non-functional proteins. Functional allelic variants are naturally occurring amino acid sequence variants of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein within a population that maintain the ability to bind a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 ligand or substrate and/or modulate cell proliferation and/or migration mechanisms. Functional allelic variants will typically contain only conservative substitution of one or more amino acids of SEQ ID NO:2, 5, 8, 11, 40, 55, 57, 60, 64, 67, 76, 80, 83, 90, 93, 96, 108, 113, 118, 121, 128, 140 or 152, or substitution, deletion or insertion of non-critical residues in non-critical regions of the protein. Non-functional allelic variants are naturally-occurring amino acid sequence variants of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252, e.g., human 13237, 18480, 2245, 16228, 7677, 26320, 46619, 33166, 16836, 46867, 21617, 55562, 39228, 62088, 46745, 23155, 21657, 42755, 32229, 22325, 46863 or 32252, protein within a population that do not have the ability to bind a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 ligand or substrate and/or modulate cell proliferation and/or migration mechanisms. Non-functional allelic variants will typically contain a non-conservative substitution, a deletion, or insertion, or premature truncation of the amino acid sequence of SEQ ID NO:2, 5, 8, 11, 40, 55, 57, 60, 64, 67, 76, 80, 83, 90, 93, 96, 108, 113, 118, 121, 128, 140 or 152, or a substitution, insertion, or deletion in critical residues or critical regions of the protein.

Moreover, nucleic acid molecules encoding other 13237, 18480, 2245, 16228, 7677, 26320, 46619, 33166, 16836, 46867, 21617, 55562, 39228, 62088, 46745, 23155, 21657, 42755, 32229, 22325, 46863 or 32252 family members and, thus, which have a nucleotide sequence which differs from the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 sequences of SEQ ID NO:1, 3, 4, 6, 7, 9, 10, 12, 39, 41, 54, 56, 58, 59, 61, 63, 65, 66, 68, 75, 77, 79, 81, 82, 84, 89, 91, 92, 94, 95, 97, 107, 109, 112, 114, 117, 119, 120, 122, 127, 129, 139, 141, 151 or 153 are intended to be within the scope of the invention.

Antisense Nucleic Acid Molecules, Ribozymes and Modified 13237, 18480, 2245, 16228, 7677, 26320, 46619, 33166, 16836, 46867, 21617, 55562, 39228, 62088, 46745, 23155, 21657, 42755, 32229, 22325, 46863 or 32252 Nucleic Acid Molecules In another aspect, the invention features, an isolated nucleic acid molecule which is antisense to 13237, 18480, 2245, 16228, 7677, 26320, 46619, 33166, 16836, 46867, 21617, 55562, 39228, 62088, 46745, 23155, 21657, 42755, 32229, 22325, 46863 or 32252. An "antisense" nucleic acid can include a nucleotide sequence which is complementary to a "sense" nucleic acid encoding a protein, e.g., complementary to the coding strand of a double-stranded cDNA molecule or complementary to an mRNA sequence. The antisense nucleic acid can be complementary to an entire 13237, 18480, 2245, 16228, 7677, 26320, 46619, 33166, 16836, 46867, 21617, 55562, 39228, 62088, 46745, 23155, 21657, 42755, 32229, 22325, 46863 or 32252 coding strand, or to only a portion thereof (e.g., the coding region of human 13237, 18480, 2245, 16228, 7677, 26320, 46619, 33166, 16836, 46867, 21617, 55562, 39228, 62088, 46745, 23155, 21657, 42755, 32229, 22325, 46863 or 32252 corresponding to SEQ ID NO:3, 6, 9, 12, 41, 56, 58, 61, 65, 68, 77, 81, 84, 91, 94, 97, 109, 114, 119, 122, 129, 141 or 153, respectively). In another embodiment, the antisense nucleic acid molecule is antisense to a "noncoding region" of the coding strand of a nucleotide sequence encoding 13237, 18480, 2245, 16228, 7677, 26320, 46619, 33166, 16836, 46867, 21617, 55562, 39228, 62088, 46745, 23155, 21657, 42755, 32229, 22325, 46863 or 32252 (e.g., the 5' and 3' untranslated regions).

An antisense nucleic acid can be designed such that it is complementary to the entire coding region of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 mRNA, but more preferably is an oligonucleotide which is antisense to only a portion of the coding or noncoding region of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 mRNA. For example, the antisense oligonucleotide can be complementary to the region surrounding the translation start site of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 mRNA, e.g., between the −10 and +10 regions of the target gene nucleotide sequence of interest. An antisense oligonucleotide can be, for example, about 7, 10, 15, 20, 25, 30, 35, 40, 45, 50, 55, 60, 65, 70, 75, 80, or more nucleotides in length.

An antisense nucleic acid of the invention can be constructed using chemical synthesis and enzymatic ligation reactions using procedures known in the art. For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. The antisense nucleic acid also can be produced biologically using an expression vector into which a nucleic acid has been subcloned in an antisense orientation (i.e., RNA transcribed from the inserted nucleic acid will be of an antisense orientation to a target nucleic acid of interest, described further in the following subsection).

The antisense nucleic acid molecules of the invention are typically administered to a subject (e.g., by direct injection at a tissue site), or generated in situ such that they hybridize with or bind to cellular mRNA and/or genomic DNA encoding a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein to thereby inhibit expression of the protein, e.g., by inhibiting transcription and/or translation. Alternatively, antisense nucleic acid molecules can be modified to target selected cells and then administered systemically. For systemic administration, antisense molecules can be modified such that they specifically or selectively bind to receptors or antigens expressed on a selected cell surface, e.g., by linking the antisense nucleic acid molecules to peptides or antibodies which bind to cell surface receptors or antigens. The antisense nucleic acid molecules can also be delivered to cells using the vectors described herein. To achieve sufficient intracellular concentrations of the antisense molecules, vector constructs in which the antisense nucleic acid molecule is placed under the control of a strong pol II or pol III promoter are preferred.

In yet another embodiment, the antisense nucleic acid molecule of the invention is an α-anomeric nucleic acid molecule. An α-anomeric nucleic acid molecule forms specific double-stranded hybrids with complementary RNA in which, contrary to the usual 0-units, the strands run parallel to each other (Gaultier et al. (1987) *Nucleic Acids. Res.* 15:6625-6641). The antisense nucleic acid molecule can also comprise a 2'-o-methylribonucleotide (Inoue et al. (1987) *Nucleic Acids Res.* 15:6131-6148) or a chimeric RNA-DNA analogue (Inoue et al. (1987) *FEBS Lett.* 215:327-330).

In still another embodiment, an antisense nucleic acid of the invention is a ribozyme. A ribozyme having specificity for a 13237, 18480, 2245, 16228, 7677, 26320, 46619, 33166, 16836, 46867, 21617, 55562, 39228, 62088, 46745, 23155, 21657, 42755, 32229, 22325, 46863 or 32252-encoding nucleic acid can include one or more sequences complementary to the nucleotide sequence of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 cDNA disclosed herein (i.e., SEQ ID NO:1, 3, 4, 6, 7, 9, 10, 12, 39, 41, 54, 56, 58, 59, 61, 63, 65, 66, 68, 75, 77, 79, 81, 82, 84, 89, 91, 92, 94, 95, 97, 107, 109, 112, 114, 117, 119, 120, 122, 127, 129, 139, 141, 151 or 153), and a sequence having known catalytic sequence responsible for mRNA cleavage (see U.S. Pat. No. 5,093,246 or Haselhoff and Gerlach (1988) *Nature* 334:585-591). For example, a derivative of a Tetrahymena L-19 IVS RNA can be constructed in which the nucleotide sequence of the active site is complementary to the nucleotide sequence to be cleaved in a 13237, 18480, 2245, 16228, 7677, 26320, 46619, 33166, 16836, 46867, 21617, 55562, 39228, 62088, 46745, 23155, 21657, 42755, 32229, 22325, 46863 or 32252-encoding mRNA. See, e.g., Cech et al. U.S. Pat. No. 4,987,071; and Cech et al. U.S. Pat. No. 5,116,742. Alternatively, 13237, 18480, 2245, 16228, 7677, 26320, 46619, 33166, 16836, 46867, 21617, 55562, 39228, 62088, 46745, 23155, 21657, 42755, 32229, 22325, 46863 or 32252 mRNA can be used to select a catalytic RNA having a specific ribonuclease activity from a pool of RNA molecules. See, e.g., Bartel and Szostak (1993) *Science* 261:1411-1418.

13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene expression can be inhibited by targeting nucleotide sequences complementary to the regulatory region of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 (e.g., the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 promoter and/or enhancers) to form triple helical structures that prevent transcription of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene in target cells. See generally, Helene (1991) *Anticancer Drug Des.* 6:569-84; Helene (1992) *Ann. N.Y. Acad. Sci.* 660:27-36; and Maher (1992) *Bioassays* 14:807-15. The potential sequences that can be targeted for triple helix formation can be increased by creating a so-called "switchback" nucleic acid molecule. Switchback molecules are synthesized in an alternating 5'-3', 3'-5' manner, such that they base pair with first one strand of a duplex and then the other, eliminating the necessity for a sizeable stretch of either purines or pyrimidines to be present on one strand of a duplex.

The invention also provides detectably labeled oligonucleotide primer and probe molecules. Typically, such labels are chemiluminescent, fluorescent, radioactive, or colorimetric.

A 13237, 18480, 2245, 16228, 7677, 26320, 46619, 33166, 16836, 46867, 21617, 55562, 39228, 62088, 46745, 23155, 21657, 42755, 32229, 22325, 46863 or 32252 nucleic acid molecule can be modified at the base moiety, sugar moiety or phosphate backbone to improve, e.g., the stability, hybridization, or solubility of the molecule. For example, the deoxyribose phosphate backbone of the nucleic acid molecules can be modified to generate peptide nucleic acids (see Hyrup et al. (1996) *Bioorganic & Medicinal Chemistry* 4: 5-23).

As used herein, the terms "peptide nucleic acid" or "PNA" refers to a nucleic acid mimic, e.g., a DNA mimic, in which the deoxyribose phosphate backbone is replaced by a pseudopeptide backbone and only the four natural nucleobases are retained. The neutral backbone of a PNA can allow for specific hybridization to DNA and RNA under conditions of low ionic strength. The synthesis of PNA oligomers can be performed using standard solid phase peptide synthesis protocols as described in Hyrup et al. (1996) supra; Perry-O'Keefe et al. (1996) *Proc. Natl. Acad. Sci.* 93: 14670-675.

PNAs of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 nucleic acid molecules can be used in therapeutic and diagnostic applications. For example, PNAs can be used as antisense or antigene agents for sequence-specific modulation of gene expression by, for example, inducing transcription or translation arrest or inhibiting replication. PNAs of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 nucleic acid molecules can also be used in the analysis of single base pair mutations in a gene, (e.g., by PNA-directed PCR clamping); as 'artificial restriction enzymes' when used in combination with other enzymes, (e.g., S1 nucleases (Hyrup et al. (1996) supra)); or as probes or primers for DNA sequencing or hybridization (Hyrup et al. (1996) supra; Perry-O'Keefe supra).

In other embodiments, the oligonucleotide can include other appended groups such as peptides (e.g., for targeting host cell receptors in vivo), or agents facilitating transport across the cell membrane (see, e.g., Letsinger et al. (1989) *Proc. Natl. Acad. Sci. USA* 86:6553-6556; Lemaitre et al. (1987) *Proc. Natl. Acad. Sci. USA* 84:648-652; PCT Publication No. WO88/09810) or the blood-brain barrier (see, e.g., PCT Publication No. WO89/10134). In addition, oligonucleotides can be modified with hybridization-triggered cleavage agents (see, e.g., Krol et al. (1988) *Bio-Techniques* 6:958-976) or intercalating agents. (see, e.g., Zon (1988) *Pharm. Res.* 5:539-549). To this end, the oligonucleotide can be conjugated to another molecule, (e.g., a peptide, hybridization triggered cross-linking agent, transport agent, or hybridization-triggered cleavage agent).

The invention also includes molecular beacon oligonucleotide primer and probe molecules having at least one region which is complementary to a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 nucleic acid of the invention, two complementary regions one having a fluorophore and one a quencher such that the molecular beacon is useful for quantitating the presence of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 nucleic acids of the invention in a sample. Molecular beacon nucleic acids are described, for example, in Lizardi et al., U.S. Pat. No. 5,854,033; Nazarenko et al., U.S. Pat. No. 5,866,336, and Livak et al., U.S. Pat. No. 5,876,930.

Isolated 13237, 18480, 2245, 16228, 7677, 26320, 46619, 33166, 16836, 46867, 21617, 55562, 39228, 62088, 46745, 23155, 21657, 42755, 32229, 22325, 46863 or 32252 Polypeptides In another aspect, the invention features, an isolated 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein, or fragment, e.g., a biologically active portion, for use as immunogens or antigens to raise or test (or more generally to bind) anti-13237, 18480, 2245, 16228, 7677, 26320, 46619, 33166, 16836, 46867, 21617, 55562, 39228, 62088, 46745, 23155, 21657, 42755, 32229, 22325, 46863 or 32252 antibodies. 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein can be isolated from cells or tissue sources using standard protein purification techniques. 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein or fragments thereof can be produced by recombinant DNA techniques or synthesized chemically.

Polypeptides of the invention include those which arise as a result of the existence of multiple genes, alternative transcription events, alternative RNA splicing events, and alternative translational and post-translational events. The polypeptide can be expressed in systems, e.g., cultured cells, which result in substantially the same post-translational modifications present when the polypeptide is expressed in a native cell, or in systems which result in the alteration or omission of post-translational modifications, e.g., glycosylation or cleavage, present in a native cell.

In a preferred embodiment, a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptide has one or more of the following characteristics:

it has the ability to it has the ability to reversibly phosphorylate proteins in order to regulate protein activity in eukaryotic cells; (ii) it has the ability to catalyze the transfer of an acyl chain to a lipid precursor; (iii) it has the ability to transfer a carboxyl group from an organic substrate, e.g., bicarbonate to a co-factor, e.g., biotin; (iv) it has the ability to oxidize an alcohol group on a substrate molecule; (v) it has the ability to reduce a carbonyl group on a substrate molecule; (vi) it has the ability bind a co-enzyme; (vii) it participates in the metabolism of a substrate, e.g., a small molecule substrate, e.g., an alcohol, steroid, or fatty acid molecule; (viii) it has the ability to oxidize an alcohol group on a substrate molecule; (ix) it has the ability to reduce a carbonyl group on a substrate molecule; (x) it has the ability bind a co-enzyme; (xi) it binds to and hydrolyzes ATP, playing a pivotal role in translating chemically stored energy into biological energy; (xii) it is involved in a condensation reaction between acyl and malonyl groups to yield beta-ketoacyl derivatives; (xiii) it has the ability to catalyze an acyl-CoA ligase or acetoacetyl-CoA synthetase reaction; (xiv) it has the ability to catalyze the hydrolysis of phosphatidylinositol; (xv) it has the ability to associate with ras, preferably activated (GTP-bound) ras; (xvi) it has the ability to mediate guanine nucleotide exchange activity; (xvii) it has a molecular weight, e.g., a deduced molecular weight, preferably ignoring any contribution of post translational modifications, amino acid composition or other physical characteristic of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptide, e.g., a polypeptide of SEQ ID NO:2, 5, 8, 11, 40, 55, 57, 60, 64, 67, 76, 80, 83, 90, 93, 96, 108, 113, 118, 121, 128, 140 or 152; (xviii) it has an overall sequence similarity of at least 60%, preferably at least 70%, more preferably at least 80, 90, or 95%, with a polypeptide of SEQ ID NO:2, 5, 8, 11, 40, 55, 57, 60, 64, 67, 76, 80, 83, 90, 93, 96, 108, 113, 118, 121, 128, 140 or 152; (xix) it is expressed in a multitude of human tissues and cell lines (refer to section for each molecule of the invention); and it has specific domains which are preferably about 70%, 80%, 90% or 95% identical to the identified amino acid residues of SEQ ID NO:2, 5, 8, 11, 40, 55, 57, 60, 64, 67, 76, 80, 83, 90, 93, 96, 108, 113, 118, 121, 128, 140 or 152 (refer to section for each molecule of the invention for domain names and locations within amino acid sequence).

In a preferred embodiment the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein, or fragment thereof, differs from the corresponding sequence in SEQ ID NO:2, 5, 8, 11, 40, 55, 57, 60, 64, 67, 76, 80, 83, 90, 93, 96, 108, 113, 118, 121, 128, 140 or 152. In one embodiment it differs by at least one but by less than 15, 10 or 5 amino acid residues. In another it differs from the corresponding sequence in SEQ ID NO:2, 5, 8, 11, 40, 55, 57, 60, 64, 67, 76, 80, 83, 90, 93, 96, 108, 113, 118, 121, 128, 140 or 152 by at least one residue but less than 20%, 15%, 10% or 5% of the residues in it differ from the corresponding sequence in SEQ ID NO:2, 5, 8, 11, 40, 55, 57, 60, 64, 67, 76, 80, 83, 90, 93, 96, 108, 113, 118, 121, 128, 140 or 152. (If this comparison requires alignment the sequences should be aligned for maximum homology. "Looped" out sequences from deletions or insertions, or mismatches, are considered differences.) The differences are, preferably, differences or changes at a non-essential residue or a conservative substitution. In a preferred embodiment the differences are not in the identified or conserved domain(s) within SEQ ID NO:2, 5, 8, 11, 40, 55, 57, 60, 64, 67, 76, 80, 83, 90, 93, 96, 108, 113, 118, 121, 128, 140 or 152. In another embodiment one or more differences are in the identified or conserved domain(s) within SEQ ID NO:2, 5, 8, 11, 40, 55, 57, 60, 64, 67, 76, 80, 83, 90, 93, 96, 108, 113, 118, 121, 128, 140 or 152.

Other embodiments include a protein that contains one or more changes in amino acid sequence, e.g., a change in an amino acid residue which is not essential for activity. Such 13237, 18480, 2245, 16228, 7677, 26320, 46619, 33166, 16836, 46867, 21617, 55562, 39228, 62088, 46745, 23155, 21657, 42755, 32229, 22325, 46863 or 32252 proteins differ in amino acid sequence from SEQ ID NO:2, 5, 8, 11, 40, 55, 57, 60, 64, 67, 76, 80, 83, 90, 93, 96, 108, 113, 118, 121, 128, 140 or 152, yet retain biological activity.

In one embodiment, the protein includes an amino acid sequence at least about 60%, 65%, 70%, 75%, 80%, 85%, 90%, 95%, 98% or more homologous to SEQ ID NO:2, 5, 8, 11, 40, 55, 57, 60, 64, 67, 76, 80, 83, 90, 93, 96, 108, 113, 118, 121, 128, 140 or 152.

A 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein or fragment is provided which varies from the sequence of SEQ ID NO:2, 5, 8, 11, 40, 55, 57, 60, 64, 67, 76, 80, 83, 90, 93, 96, 108, 113, 118, 121, 128, 140 or 152 in regions defined by amino acids that are not within identified or conserved domains or regions by at least one but by less than 15, 10 or 5 amino acid residues in the protein or fragment but which does not differ from SEQ ID NO:2, 5, 8, 11, 40, 55, 57, 60, 64, 67, 76, 80, 83, 90, 93, 96, 108, 113, 118, 121, 128, 140 or 152 in regions defined by amino acids that are within identified or conserved domains or regions. (If this comparison requires alignment the sequences should be aligned for maximum homology. "Looped" out sequences from deletions or insertions, or mismatches, are considered differences.) In some embodiments the difference is at a non-essential residue or is a conservative substitution, while in others the difference is at an essential residue or is a non-conservative substitution.

In one embodiment, a biologically active portion of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein includes an identified domain (refer to section for each molecule of the invention). Moreover, other biologically active portions, in which other regions of the protein are deleted, can be prepared by recombinant techniques and evaluated for one or more of the functional activities of a native 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein.

In a preferred embodiment, the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein has an amino acid sequence shown in SEQ ID NO:2, 5, 8, 11, 40, 55, 57, 60, 64, 67, 76, 80, 83, 90, 93, 96, 108, 113, 118, 121, 128, 140 or 152. In other embodiments, the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein is sufficiently or substantially identical to SEQ ID NO:2, 5, 8, 11, 40, 55, 57, 60, 64, 67, 76, 80, 83, 90, 93, 96, 108, 113, 118, 121, 128, 140 or 152. In yet another embodiment, the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein is sufficiently or substantially identical to SEQ ID NO:2, 5, 8, 11, 40, 55, 57, 60, 64, 67, 76, 80, 83, 90, 93, 96, 108, 113, 118, 121, 128, 140 or 152 and retains the functional activity of the protein of SEQ ID NO:2, 5, 8, 11, 40, 55, 57, 60, 64, 67, 76, 80, 83, 90, 93, 96, 108, 113, 118, 121, 128, 140 or 152, as described in detail in the subsections above.

13237, 18480, 2245, 16228, 7677, 26320, 46619, 33166, 16836, 46867.21617.55562, 39228, 62088, 46745, 23155, 21657, 42755, 32229, 22325, 46863 or 32252 Chimeric or Fusion Proteins In another aspect, the invention provides 13237, 18480, 2245, 16228, 7677, 26320, 46619, 33166, 16836, 46867, 21617, 55562, 39228, 62088, 46745, 23155, 21657, 42755, 32229, 22325, 46863 or 32252 chimeric or fusion proteins. As used herein, a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 "chimeric protein" or "fusion protein" includes a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptide linked to a non-13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptide. A "non-13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptide" refers to a polypeptide having an amino acid sequence corresponding to a protein which is not substantially homologous to the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein, e.g., a protein which is different from the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein and which is derived from the same or a different organism. The 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptide of the fusion protein can correspond to all or a portion e.g., a fragment described herein of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 amino acid sequence. In a preferred embodiment, a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 fusion protein includes at least one (or two) biologically active portion of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein. The non-13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptide can be fused to the N-terminus or C-terminus of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptide.

The fusion protein can include a moiety which has a high affinity for a ligand. For example, the fusion protein can be a GST-13237, 18480, 2245, 16228, 7677, 26320, 46619, 33166, 16836, 46867, 21617, 55562, 39228, 62088, 46745, 23155, 21657, 42755, 32229, 22325, 46863 or 32252 fusion protein in which the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 sequences are fused to the C-terminus of the GST sequences. Such fusion proteins can facilitate the purification of recombinant 13237, 18480, 2245, 16228, 7677, 26320, 46619, 33166, 16836, 46867, 21617, 55562, 39228, 62088, 46745, 23155, 21657, 42755, 32229, 22325, 46863 or 32252. Alternatively, the fusion protein can be a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein containing a heterologous signal sequence at its N-terminus. In certain host cells (e.g., mammalian host cells), expression and/or secretion of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 can be increased through use of a heterologous signal sequence.

Fusion proteins can include all or a part of a serum protein, e.g., a portion of an immunoglobulin (e.g., IgG, IgA, or IgE), e.g., an Fc region and/or the hinge C1 and C2 sequences of an immunoglobulin or human serum albumin.

The 13237, 18480, 2245, 16228, 7677, 26320, 46619, 33166, 16836, 46867, 21617, 55562, 39228, 62088, 46745, 23155, 21657, 42755, 32229, 22325, 46863 or 32252 fusion proteins of the invention can be incorporated into pharmaceutical compositions and administered to a subject in vivo. The 13237, 18480, 2245, 16228, 7677, 26320, 46619, 33166, 16836, 46867, 21617, 55562, 39228, 62088, 46745, 23155, 21657, 42755, 32229, 22325, 46863 or 32252 fusion proteins can be used to affect the bioavailability of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 substrate. 13237, 18480, 2245, 16228, 7677, 26320, 46619, 33166, 16836, 46867, 21617, 55562, 39228, 62088, 46745, 23155, 21657, 42755, 32229, 22325, 46863 or 32252 fusion proteins can be useful therapeutically for the treatment of disorders caused by, for example, (i) aberrant modification or mutation of a gene encoding a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein; (ii) mis-regulation of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene; and (iii) aberrant post-translational modification of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein.

Moreover, the 13237, 18480, 2245, 16228, 7677, 26320, 46619, 33166, 16836, 46867, 21617, 55562, 39228, 62088, 46745, 23155, 21657, 42755, 32229, 22325, 46863 or 32252-fusion proteins of the invention can be used as immunogens to produce anti-13237, 18480, 2245, 16228, 7677, 26320, 46619, 33166, 16836, 46867, 21617, 55562, 39228, 62088, 46745, 23155, 21657, 42755, 32229, 22325, 46863 or 32252 antibodies in a subject, to purify 13237, 18480, 2245, 16228, 7677, 26320, 46619, 33166, 16836, 46867, 21617, 55562, 39228, 62088, 46745, 23155, 21657, 42755, 32229, 22325, 46863 or 32252 ligands and in screening assays to identify molecules which inhibit the interaction of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 with a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 substrate.

Expression vectors are commercially available that already encode a fusion moiety (e.g., a GST polypeptide). A 13237, 18480, 2245, 16228, 7677, 26320, 46619, 33166, 16836, 46867, 21617, 55562, 39228, 62088, 46745, 23155, 21657, 42755, 32229, 22325, 46863 or 32252-encoding nucleic acid can be cloned into such an expression vector such that the fusion moiety is linked in-frame to the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein.

Variants of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 Proteins In another aspect, the invention also features a variant of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptide, e.g., which functions as an agonist (mimetics) or as an antagonist. Variants of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 proteins can be generated by mutagenesis, e.g., discrete point mutation, the insertion or deletion of sequences or the truncation of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein. An agonist of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 proteins can retain substantially the same, or a subset, of the biological activities of the naturally occurring form of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein. An antagonist of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein can inhibit one or more of the activities of the naturally occurring form of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein by, for example, competitively modulating a 13237, 18480, 2245, 16228, 7677, 26320, 46619, 33166, 16836, 46867, 21617, 55562, 39228, 62088, 46745, 23155, 21657, 42755, 32229, 22325, 46863 or 32252-mediated activity of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein. Thus, specific biological effects can be elicited by treatment with a variant of limited function. Preferably, treatment of a subject with a variant having a subset of the biological activities of the naturally occurring form of the protein has fewer side effects in a subject relative to treatment with the naturally occurring form of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein.

Variants of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein can be identified by screening combinatorial libraries of mutants, e.g., truncation mutants, of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein for agonist or antagonist activity.

Libraries of fragments e.g., N terminal, C terminal, or internal fragments, of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein coding sequence can be used to generate a variegated population of fragments for screening and subsequent selection of variants of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein.

Variants in which a cysteine residues is added or deleted or in which a residue which is glycosylated is added or deleted are particularly preferred.

Methods for screening gene products of combinatorial libraries made by point mutations or truncation, and for screening cDNA libraries for gene products having a selected property are known in the art. Recursive ensemble mutagenesis (REM), a new technique which enhances the frequency of functional mutants in the libraries, can be used in combination with the screening assays to identify 13237, 18480, 2245, 16228, 7677, 26320, 46619, 33166, 16836, 46867, 21617, 55562, 39228, 62088, 46745, 23155, 21657, 42755, 32229, 22325, 46863 or 32252 variants (Arkin and Yourvan (1992) *Proc. Natl. Acad. Sci. USA* 89:7811-7815; Delgrave et al. (1993) *Protein Engineering* 6:327-331).

Cell based assays can be exploited to analyze a variegated 13237, 18480, 2245, 16228, 7677, 26320, 46619, 33166, 16836, 46867, 21617, 55562, 39228, 62088, 46745, 23155, 21657, 42755, 32229, 22325, 46863 or 32252 library. For example, a library of expression vectors can be transfected into a cell line, e.g., a cell line, which ordinarily responds to 13237, 18480, 2245, 16228, 7677, 26320, 46619, 33166, 16836, 46867, 21617, 55562, 39228, 62088, 46745, 23155, 21657, 42755, 32229, 22325, 46863 or 32252 in a substrate-dependent manner. The transfected cells are then contacted with 13237, 18480, 2245, 16228, 7677, 26320, 46619, 33166, 16836, 46867, 21617, 55562, 39228, 62088, 46745, 23155, 21657, 42755, 32229, 22325, 46863 or 32252 and the effect of the expression of the mutant on signaling by the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 substrate can be detected, e.g., by measuring either protein kinase activity, methyltransferase activity, acyl-CoA dehydrogenase activity, short chain dehyrdogenase activity, reductase activity, acyltransferase activity, phosphatase activity, transferase activity, ATP-ase activity, synthase activity, or other activity. Plasmid DNA can then be recovered from the cells which score for inhibition, or alternatively, potentiation of signaling by the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 substrate, and the individual clones further characterized.

In another aspect, the invention features a method of making a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptide, e.g., a peptide having a non-wild type activity, e.g., an antagonist, agonist, or super agonist of a naturally occurring 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptide, e.g., a naturally occurring 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptide. The method includes altering the sequence of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptide, e.g., altering the sequence, e.g., by substitution or deletion of one or more residues of a non-conserved region, a domain or residue disclosed herein, and testing the altered polypeptide for the desired activity.

In another aspect, the invention features a method of making a fragment or analog of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptide a biological activity of a naturally occurring 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptide. The method includes altering the sequence, e.g., by substitution or deletion of one or more residues, of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptide, e.g., altering the sequence of a non-conserved region, or a domain or residue described herein, and testing the altered polypeptide for the desired activity.

Anti-13237, 18480, 2245, 16228, 7677, 26320, 46619, 33166, 16836, 46867, 21617, 55562, 39228, 62088, 46745, 23155, 21657, 42755, 32229, 22325, 46863 or 32252 Antibodies In another aspect, the invention provides an anti-13237, 18480, 2245, 16228, 7677, 26320, 46619, 33166, 16836, 46867, 21617, 55562, 39228, 62088, 46745, 23155, 21657, 42755, 32229, 22325, 46863 or 32252 antibody. The term "antibody" as used herein refers to an immunoglobulin molecule or immunologically active portion thereof, i.e., an antigen-binding portion. Examples of immunologically active portions of immunoglobulin molecules include scFV and dcFV fragments, Fab and F(ab')$_2$ fragments which can be generated by treating the antibody with an enzyme such as papain or pepsin, respectively.

The antibody can be a polyclonal, monoclonal, recombinant, e.g., a chimeric or humanized, fully human, non-human, e.g., murine, or single chain antibody. In a preferred embodiment it has effector function and can fix complement. The antibody can be coupled to a toxin or imaging agent.

A full-length 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein or, antigenic peptide fragment of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 can be used as an immunogen or can be used to identify anti-13237, 18480, 2245, 16228, 7677, 26320, 46619, 33166, 16836, 46867, 21617, 55562, 39228, 62088, 46745, 23155, 21657, 42755, 32229, 22325, 46863 or 32252 antibodies made with other immunogens, e.g., cells, membrane preparations, and the like. The antigenic peptide of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 should include at least 8 amino acid residues of the amino acid sequence shown in SEQ ID NO:2, 5, 8, 11, 40, 55, 57, 60, 64, 67, 76, 80, 83, 90, 93, 96, 108, 113, 118, 121, 128, 140 or 152 and encompasses an epitope of 13237, 18480, 2245, 16228, 7677, 26320, 46619, 33166, 16836, 46867, 21617, 55562, 39228, 62088, 46745, 23155, 21657, 42755, 32229, 22325, 46863 or 32252. Preferably, the antigenic peptide includes at least 10 amino acid residues, more preferably at least 15 amino acid residues, even more preferably at least 20 amino acid residues, and most preferably at least 30 amino acid residues.

Fragments of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 which include hydrophilic regions of SEQ ID NO:2, 5, 8, 11, 40, 55, 57, 60, 64, 67, 76, 80, 83, 90, 93, 96, 108, 113, 118, 121, 128, 140 or 152 can be used to make, e.g., used as immunogens or used to characterize the specificity of an antibody, antibodies against hydrophilic regions of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein. Similarly, fragments of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 which include hydrophobic regions of SEQ ID NO:2, 5, 8, 11, 40, 55, 57, 60, 64, 67, 76, 80, 83, 90, 93, 96, 108, 113, 118, 121, 128, 140 or 152 can be used to make an antibody against a hydrophobic region of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein; fragments of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 which include residues within extra cellular domain(s) of SEQ ID NO:2, 5, 8, 11, 40, 55, 57, 60, 64, 67, 76, 80, 83, 90, 93, 96, 108, 113, 118, 121, 128, 140 or 152 can be used to make an antibody against an extracellular or non-cytoplasmic region of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein; fragments of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 which include residues within intracellular regions of SEQ ID NO:2, 5, 8, 11, 40, 55, 57, 60, 64, 67, 76, 80, 83, 90, 93, 96, 108, 113, 118, 121, 128, 140 or 152 can be used to make an antibody against an intracellular region of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein; a fragment of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 which include residues within identified or conserved domains of SEQ ID NO:2, 5, 8, 11, 40, 55, 57, 60, 64, 67, 76, 80, 83, 90, 93, 96, 108, 113, 118, 121, 128, 140 or 152 can be used to make an antibody against the identified or conserved domain of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein.

Antibodies reactive with, or specific or selective for, any of these regions, or other regions or domains described herein are provided.

Preferred epitopes encompassed by the antigenic peptide are regions of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 located on the surface of the protein, e.g., hydrophilic regions, as well as regions with high antigenicity. For example, an Emini surface probability analysis of the human 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein sequence can be used to indicate the regions that have a particularly high probability of being localized to the surface of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein and are thus likely to constitute surface residues useful for targeting antibody production.

In a preferred embodiment the antibody can bind to the extracellular portion of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein, e.g., it can bind to a whole cell which expresses the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein. In another embodiment, the antibody binds an intracellular portion of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein.

In a preferred embodiment the antibody binds an epitope on any domain or region on 13237, 18480, 2245, 16228, 7677, 26320, 46619, 33166, 16836, 46867, 21617, 55562, 39228, 62088, 46745, 23155, 21657, 42755, 32229, 22325, 46863 or 32252 proteins described herein.

Additionally, chimeric, humanized, and completely human antibodies are also within the scope of the invention. Chimeric, humanized, but most preferably, completely human antibodies are desirable for applications which include repeated administration, e.g., therapeutic treatment of human patients, and some diagnostic applications.

Chimeric and humanized monoclonal antibodies, comprising both human and non-human portions, can be made using standard recombinant DNA techniques. Such chimeric and humanized monoclonal antibodies can be produced by recombinant DNA techniques known in the art, for example using methods described in Robinson et al. International Application No. PCT/US86/02269; Akira, et al. European Patent Application 184,187; Taniguchi, European Patent Application 171,496; Morrison et al. European Patent Application 173,494; Neuberger et al. PCT International Publication No. WO 86/01533; Cabilly et al. U.S. Pat. No. 4,816,567; Cabilly et al. European Patent Application 125,023; Better et al. (1988) *Science* 240:1041-1043; Liu et al. (1987) *Proc. Natl. Acad. Sci. USA* 84:3439-3443; Liu et al. (1987) *J. Immunol.* 139:3521-3526; Sun et al. (1987) *Proc. Natl. Acad. Sci. USA* 84:214-218; Nishimura et al. (1987) *Canc. Res.* 47:999-1005; Wood et al. (1985) *Nature* 314:446-449; and Shaw et al. (1988) *J. Natl. Cancer Inst.* 80:1553-1559).

A humanized or complementarity determining region (CDR)-grafted antibody will have at least one or two, but generally all three recipient CDR's (of heavy and or light immuoglobulin chains) replaced with a donor CDR. The antibody may be replaced with at least a portion of a non-human CDR or only some of the CDR's may be replaced with non-human CDR's. It is only necessary to replace the number of CDR's required for binding of the humanized antibody to a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 or a fragment thereof. Preferably, the donor will be a rodent antibody, e.g., a rat or mouse antibody, and the recipient will be a human framework or a human consensus framework. Typically, the immunoglobulin providing the CDR's is called the "donor" and the immunoglobulin providing the framework is called the "acceptor." In one embodiment, the donor immunoglobulin is a non-human (e.g., rodent). The acceptor framework is a naturally-occurring (e.g., a human) framework or a consensus framework, or a sequence about 85% or higher, preferably 90%, 95%, 99% or higher identical thereto.

As used herein, the term "consensus sequence" refers to the sequence formed from the most frequently occurring amino acids (or nucleotides) in a family of related sequences (See e.g., Winnaker, (1987) *From Genes to Clones* (Verlagsgesellschaft, Weinheim, Germany). In a family of proteins, each position in the consensus sequence is occupied by the amino acid occurring most frequently at that position in the family. If two amino acids occur equally frequently, either can be included in the consensus sequence. A "consensus framework" refers to the framework region in the consensus immunoglobulin sequence.

An antibody can be humanized by methods known in the art. Humanized antibodies can be generated by replacing sequences of the Fv variable region which are not directly involved in antigen binding with equivalent sequences from human Fv variable regions. General methods for generating humanized antibodies are provided by Morrison (1985) *Science* 229:1202-1207, by Oi et al. (1986) *BioTechniques* 4:214, and by Queen et al. U.S. Pat. Nos. 5,585,089, 5,693,761 and 5,693,762, the contents of all of which are hereby incorporated by reference. Those methods include isolating, manipulating, and expressing the nucleic acid sequences that encode all or part of immunoglobulin Fv variable regions from at least one of a heavy or light chain. Sources of such nucleic acid are well known to those skilled in the art and, for example, may be obtained from a hybridoma producing an antibody against a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptide or fragment thereof. The recombinant DNA encoding the humanized antibody, or fragment thereof, can then be cloned into an appropriate expression vector.

Humanized or CDR-grafted antibodies can be produced by CDR-grafting or CDR substitution, wherein one, two, or all CDR's of an immunoglobulin chain can be replaced. See e.g., U.S. Pat. No. 5,225,539; Jones et al. (1986) *Nature* 321:552-525; Verhoeyan et al. (1988) *Science* 239:1534; Beidler et al. (1988) *J. Immunol.* 141:4053-4060; Winter U.S. Pat. No. 5,225,539, the contents of all of which are hereby expressly incorporated by reference. Winter describes a CDR-grafting method which may be used to prepare the humanized antibodies of the present invention (UK Patent Application GB 2188638A, filed on Mar. 26, 1987; Winter U.S. Pat. No. 5,225,539), the contents of which is expressly incorporated by reference.

Also within the scope of the invention are humanized antibodies in which specific amino acids have been substituted, deleted or added. Preferred humanized antibodies have amino acid substitutions in the framework region, such as to improve binding to the antigen. For example, a humanized antibody will have framework residues identical to the donor framework residue or to another amino acid other than the recipient framework residue. To generate such antibodies, a selected, small number of acceptor framework residues of the humanized immunoglobulin chain can be replaced by the corresponding donor amino acids. Preferred locations of the substitutions include amino acid residues adjacent to the CDR, or which are capable of interacting with a CDR (see e.g., U.S. Pat. No. 5,585,089). Criteria for selecting amino acids from the donor are described in U.S. Pat. No. 5,585,089, e.g., columns 12-16 of U.S. Pat. No. 5,585,089, the e.g., columns 12-16 of U.S. Pat. No. 5,585,089, the contents of which are hereby incorporated by reference. Other techniques for humanizing antibodies are described in Padlan et al. EP 519596 A1, published on Dec. 23, 1992.

Completely human antibodies are particularly desirable for therapeutic treatment of human patients. Such antibodies can be produced using transgenic mice that are incapable of expressing endogenous immunoglobulin heavy and light chains genes, but which can express human heavy and light chain genes. See, for example, Lonberg and Huszar (1995) *Int. Rev. Immunol.* 13:65-93); and U.S. Pat. Nos. 5,625,126; 5,633,425; 5,569,825; 5,661,016; and 5,545,806. In addition, companies such as Abgenix, Inc. (Fremont, Calif.) and Medarex, Inc. (Princeton, N.J.), can be engaged to provide human antibodies directed against a selected antigen using technology similar to that described above.

Completely human antibodies that recognize a selected epitope can be generated using a technique referred to as "guided selection." In this approach a selected non-human monoclonal antibody, e.g., a murine antibody, is used to guide the selection of a completely human antibody recognizing the same epitope. This technology is described by Jespers et al. (1994) *Bio/Technology* 12:899-903).

The anti-13237, 18480, 2245, 16228, 7677, 26320, 46619, 33166, 16836, 46867, 21617, 55562, 39228, 62088, 46745, 23155, 21657, 42755, 32229, 22325, 46863 or 32252 antibody can be a single chain antibody. A single-chain antibody (scFV) can be engineered as described in, for example, Colcher et al. (1999) *Ann. N Y Acad. Sci.* 880:263-80; and Reiter (1996) *Clin. Cancer Res.* 2:245-52. The single chain antibody can be dimerized or multimerized to generate multivalent antibodies having specificities for different epitopes of the same target 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein.

In a preferred embodiment, the antibody has reduced or no ability to bind an Fc receptor. For example, it is an isotype or subtype, fragment or other mutant, which does not support binding to an Fc receptor, e.g., it has a mutagenized or deleted Fc receptor binding region.

An antibody (or fragment thereof) may be conjugated to a therapeutic moiety such as a cytotoxin, a therapeutic agent or a radioactive ion. A cytotoxin or cytotoxic agent includes any agent that is detrimental to cells. Examples include taxol, cytochalasin B, gramicidin D, ethidium bromide, emetine, mitomycin, etoposide, tenoposide, vincristine, vinblastine, colchicin, doxorubicin, daunorubicin, dihydroxy anthracin dione, mitoxantrone, mithramycin, actinomycin D, 1-dehydrotestosterone, glucocorticoids, procaine, tetracaine, lidocaine, propranolol, puromycin, maytansinoids, e.g., maytansinol (see U.S. Pat. No. 5,208,020), CC-1065 (see U.S. Pat. Nos. 5,475,092, 5,585,499, 5,846,545) and analogs or homologs thereof. Therapeutic agents include, but are not limited to, antimetabolites (e.g., methotrexate, 6-mercaptopurine, 6-thioguanine, cytarabine, 5-fluorouracil decarbazine), alkylating agents (e.g., mechlorethamine, thioepa chlorambucil, CC-1065, melphalan, carmustine (BSNU) and lomustine (CCNU), cyclothosphamide, busulfan, dibromomannitol, streptozotocin, mitomycin C, and cis-dichlorodiamine platinum (II) (DDP) cisplatin), anthracyclines (e.g., daunorubicin (formerly daunomycin) and doxorubicin), antibiotics (e.g., dactinomycin (formerly actinomycin), bleomycin, mithramycin, and anthramycin (AMC)), and anti-mitotic agents (e.g., vincristine, vinblastine, taxol and maytansinoids).

Radioactive ions include, but are not limited to iodine, yttrium and praseodymium.

The conjugates of the invention can be used for modifying a given biological response, the therapeutic moiety is not to be construed as limited to classical chemical therapeutic agents. For example, the therapeutic moiety may be a protein or polypeptide possessing a desired biological activity. Such proteins may include, for example, a toxin such as abrin, ricin A, pseudomonas exotoxin, or diphtheria toxin; a protein such as tumor necrosis factor, α-interferon, β-interferon, nerve growth factor, platelet derived growth factor, tissue plasminogen activator; or, biological response modifiers such as, for example, lymphokines, interleukin-1 ("IL-1"), interleukin-2 ("IL-2"), interleukin-6 ("IL-6"), granulocyte macrophase colony stimulating factor ("GM-CSF"), granulocyte colony stimulating factor ("G-CSF"), or other growth factors.

Alternatively, an antibody can be conjugated to a second antibody to form an antibody heteroconjugate as described by Segal in U.S. Pat. No. 4,676,980.

An anti-13237, 18480, 2245, 16228, 7677, 26320, 46619, 33166, 16836, 46867, 21617, 55562, 39228, 62088, 46745, 23155, 21657, 42755, 32229, 22325, 46863 or 32252 antibody (e.g., monoclonal antibody) can be used to isolate 13237, 18480, 2245, 16228, 7677, 26320, 46619, 33166, 16836, 46867, 21617, 55562, 39228, 62088, 46745, 23155, 21657, 42755, 32229, 22325, 46863 or 32252 by standard techniques, such as affinity chromatography or immunoprecipitation. Moreover, an anti-13237, 18480, 2245, 16228, 7677, 26320, 46619, 33166, 16836, 46867, 21617, 55562, 39228, 62088, 46745, 23155, 21657, 42755, 32229, 22325, 46863 or 32252 antibody can be used to detect 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein (e.g., in a cellular lysate or cell supernatant) in order to evaluate the abundance and pattern of expression of the protein. Anti-13237, 18480, 2245, 16228, 7677, 26320, 46619, 33166, 16836, 46867, 21617, 55562, 39228, 62088, 46745, 23155, 21657, 42755, 32229, 22325, 46863 or 32252 antibodies can be used diagnostically to monitor protein levels in tissue as part of a clinical testing procedure, e.g., to determine the efficacy of a given treatment regimen. Detection can be facilitated by coupling (i.e., physically linking) the antibody to a detectable substance (i.e., antibody labelling). Examples of detectable substances include various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}$I, $^{131}$I, $^{35}$S or $^{3}$H.

In preferred embodiments, an antibody can be made by immunizing with a purified 13237, 18480, 2245, 16228, 7677, 26320, 46619, 33166, 16836, 46867, 21617, 55562, 39228, 62088, 46745, 23155, 21657, 42755, 32229, 22325, 46863 or 32252 antigen, or a fragment thereof, e.g., a fragment described herein, a membrane associated antigen, tissues, e.g., crude tissue preparations, whole cells, preferably living cells, lysed cells, or cell fractions, e.g., membrane fractions.

Antibodies which bind only a native 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein, only denatured or otherwise non-native 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein, or which bind both, are within the invention. Antibodies with linear or conformational epitopes are within the invention. Conformational epitopes sometimes can be identified by identifying antibodies which bind to native but not denatured 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein.

Recombinant Expression Vectors, Host Cells and Genetically Engineered Cells

In another aspect, the invention includes, vectors, preferably expression vectors, containing a nucleic acid encoding a polypeptide described herein. As used herein, the term "vector" refers to a nucleic acid molecule capable of transporting another nucleic acid to which it has been linked and can include a plasmid, cosmid or viral vector. The vector can be capable of autonomous replication or it can integrate into a host DNA. Viral vectors include, e.g., replication defective retroviruses, adenoviruses and adeno-associated viruses.

A vector can include a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 nucleic acid in a form suitable for expression of the nucleic acid in a host cell.

Preferably the recombinant expression vector includes one or more regulatory sequences operatively linked to the nucleic acid sequence to be expressed. The term "regulatory sequence" includes promoters, enhancers and other expression control elements (e.g., polyadenylation signals). Regulatory sequences include those which direct constitutive expression of a nucleotide sequence, as well as tissue-specific regulatory and/or inducible sequences. The design of the expression vector can depend on such factors as the choice of the host cell to be transformed, the level of expression of protein desired, and the like. The expression vectors of the invention can be introduced into host cells to thereby produce proteins or polypeptides, including fusion proteins or polypeptides, encoded by nucleic acids as described herein (e.g., 13237, 18480, 2245, 16228, 7677, 26320, 46619, 33166, 16836, 46867, 21617, 55562, 39228, 62088, 46745, 23155, 21657, 42755, 32229, 22325, 46863 or 32252 proteins, mutant forms of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 proteins, fusion proteins, and the like).

The recombinant expression vectors of the invention can be designed for expression of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 proteins in prokaryotic or eukaryotic cells. For example, polypeptides of the invention can be expressed in *E. coli*, insect cells (e.g., using baculovirus expression vectors), yeast cells or mammalian cells. Suitable host cells are discussed further in Goeddel, (1990) *Gene Expression Technology: Methods in Enzymology* 185, Academic Press, San Diego, Calif. Alternatively, the recombinant expression vector can be transcribed and translated in vitro, for example using T7 promoter regulatory sequences and 17 polymerase.

Expression of proteins in prokaryotes is most often carried out in *E. coli* with vectors containing constitutive or inducible promoters directing the expression of either fusion or non-fusion proteins. Fusion vectors add a number of amino acids to a protein encoded therein, usually to the amino terminus of the recombinant protein. Such fusion vectors typically serve three purposes: 1) to increase expression of recombinant protein; 2) to increase the solubility of the recombinant protein; and 3) to aid in the purification of the recombinant protein by acting as a ligand in affinity purification. Often, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Typical fusion expression vectors include pGEX (Pharmacia Biotech Inc; Smith and Johnson (1988) *Gene* 67:31-40), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein.

Purified fusion proteins can be used in 13237, 18480, 2245, 16228, 7677, 26320, 46619, 33166, 16836, 46867, 21617, 55562, 39228, 62088, 46745, 23155, 21657, 42755, 32229, 22325, 46863 or 32252 activity assays, (e.g., direct assays or competitive assays described in detail below), or to generate antibodies specific or selective for 13237, 18480, 2245, 16228, 7677, 26320, 46619, 33166, 16836, 46867, 21617, 55562, 39228, 62088, 46745, 23155, 21657, 42755, 32229, 22325, 46863 or 32252 proteins. In a preferred embodiment, a fusion protein expressed in a retroviral expression vector of the present invention can be used to infect bone marrow cells which are subsequently transplanted into irradiated recipients. The pathology of the subject recipient is then examined after sufficient time has passed (e.g., six weeks).

To maximize recombinant protein expression in *E. coli* is to express the protein in a host bacteria with an impaired capacity to proteolytically cleave the recombinant protein (Gottesman (1990) *Gene Expression Technology: Methods in Enzymology* 185, Academic Press, San Diego, Calif. 119-128). Another strategy is to alter the nucleic acid sequence of the nucleic acid to be inserted into an expression vector so that the individual codons for each amino acid are those preferentially utilized in *E. coli* (Wada et al., (1992) *Nucleic Acids Res.* 20:2111-2118). Such alteration of nucleic acid sequences of the invention can be carried out by standard DNA synthesis techniques.

The 13237, 18480, 2245, 16228, 7677, 26320, 46619, 33166, 16836, 46867, 21617, 55562, 39228, 62088, 46745, 23155, 21657, 42755, 32229, 22325, 46863 or 32252 expression vector can be a yeast expression vector, a vector for expression in insect cells, e.g., a baculovirus expression vector or a vector suitable for expression in mammalian cells.

When used in mammalian cells, the expression vector's control functions are often provided by viral regulatory elements. For example, commonly used promoters are derived from polyoma, Adenovirus 2, cytomegalovirus and Simian Virus 40.

In another embodiment, the recombinant mammalian expression vector is capable of directing expression of the nucleic acid preferentially in a particular cell type (e.g., tissue-specific regulatory elements are used to express the nucleic acid). Non-limiting examples of suitable tissue-specific promoters include the albumin promoter (liver-specific; Pinkert et al. (1987) *Genes Dev.* 1:268-277), lymphoid-specific promoters (Calame and Eaton (1988) *Adv. Immunol.* 43:235-275), in particular promoters of T cell receptors (Winoto and Baltimore (1989) *EMBO J.* 8:729-733) and immunoglobulins (Banerji et al. (1983) *Cell* 33:729-740; Queen and Baltimore (1983) *Cell* 33:741-748), neuron-specific promoters (e.g., the neurofilament promoter; Byrne and Ruddle (1989) *Proc. Natl. Acad. Sci. USA* 86:5473-5477), pancreas-specific promoters (Edlund et al. (1985) *Science* 230:912-916), and mammary gland-specific promoters (e.g., milk whey promoter; U.S. Pat. No. 4,873,316 and European Application Publication No. 264, 166). Developmentally-regulated promoters are also encompassed, for example, the murine hox promoters (Kessel and Gruss (1990) *Science* 249:374-379) and the α-fetoprotein promoter (Campes and Tilghman (1989) *Genes Dev.* 3:537-546).

The invention further provides a recombinant expression vector comprising a DNA molecule of the invention cloned into the expression vector in an antisense orientation. Regulatory sequences (e.g., viral promoters and/or enhancers) operatively linked to a nucleic acid cloned in the antisense orientation can be chosen which direct the constitutive, tissue specific or cell type specific expression of antisense RNA in a variety of cell types. The antisense expression vector can be in the form of a recombinant plasmid, phagemid or attenuated virus. For a discussion of the regulation of gene expression using antisense genes see Weintraub et al., (1986) *Reviews—Trends in Genetics* 1:1.

Another aspect the invention provides a host cell which includes a nucleic acid molecule described herein, e.g., a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 nucleic acid molecule within a recombinant expression vector or a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 nucleic acid molecule containing sequences which allow it to homologously recombine into a specific site of the host cell's genome. The terms "host cell" and "recombinant host cell" are used interchangeably herein. Such terms refer not only to the particular subject cell but to the progeny or potential progeny of such a cell. Because certain modifications can occur in succeeding generations due to either mutation or environmental influences, such progeny may not, in fact, be identical to the parent cell, but are still included within the scope of the term as used herein.

A host cell can be any prokaryotic or eukaryotic cell. For example, a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein can be expressed in bacterial cells such as E. coli, insect cells, yeast or mammalian cells (such as Chinese hamster ovary (CHO) cells or CV-1 origin, SV-40 (COS) cells). Other suitable host cells are known to those skilled in the art.

Vector DNA can be introduced into host cells via conventional transformation or transfection techniques. As used herein, the terms "transformation" and "transfection" are intended to refer to a variety of art-recognized techniques for introducing foreign nucleic acid (e.g., DNA) into a host cell, including calcium phosphate or calcium chloride co-precipitation, DEAE-dextran-mediated transfection, lipofection, or electroporation.

A host cell of the invention can be used to produce (i.e., express) a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein. Accordingly, the invention further provides methods for producing a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein using the host cells of the invention. In one embodiment, the method includes culturing the host cell of the invention (into which a recombinant expression vector encoding a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein has been introduced) in a suitable medium such that a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein is produced. In another embodiment, the method further includes isolating a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein from the medium or the host cell.

In another aspect, the invention features, a cell or purified preparation of cells which include a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 transgene, or which otherwise misexpress 13237, 18480, 2245, 16228, 7677, 26320, 46619, 33166, 16836, 46867, 21617, 55562, 39228, 62088, 46745, 23155, 21657, 42755, 32229, 22325, 46863 or 32252. The cell preparation can consist of human or non-human cells, e.g., rodent cells, e.g., mouse or rat cells, rabbit cells, or pig cells. In preferred embodiments, the cell or cells include a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 transgene, e.g., a heterologous form of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252, e.g., a gene derived from humans (in the case of a non-human cell). The 13237, 18480, 2245, 16228, 7677, 26320, 46619, 33166, 16836, 46867, 21617, 55562, 39228, 62088, 46745, 23155, 21657, 42755, 32229, 22325, 46863 or 32252 transgene can be misexpressed, e.g., overexpressed or underexpressed. In other preferred embodiments, the cell or cells include a gene which misexpresses an endogenous 13237, 18480, 2245, 16228, 7677, 26320, 46619, 33166, 16836, 46867, 21617, 55562, 39228, 62088, 46745, 23155, 21657, 42755, 32229, 22325, 46863 or 32252, e.g., a gene the expression of which is disrupted, e.g., a knockout. Such cells can serve as a model for studying disorders which are related to mutated or misexpressed 13237, 18480, 2245, 16228, 7677, 26320, 46619, 33166, 16836, 46867, 21617, 55562, 39228, 62088, 46745, 23155, 21657, 42755, 32229, 22325, 46863 or 32252 alleles or for use in drug screening.

In another aspect, the invention features, a human cell, e.g., a hematopoietic stem cell, transformed with nucleic acid which encodes a subject 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptide.

Also provided are cells, preferably human cells, e.g., human hematopoietic or fibroblast cells, in which an endogenous 13237, 18480, 2245, 16228, 7677, 26320, 46619, 33166, 16836, 46867, 21617, 55562, 39228, 62088, 46745, 23155, 21657, 42755, 32229, 22325, 46863 or 32252 is under the control of a regulatory sequence that does not normally control the expression of the endogenous 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene. The expression characteristics of an endogenous gene within a cell, e.g., a cell line or microorganism, can be modified by inserting a heterologous DNA regulatory element into the genome of the cell such that the inserted regulatory element is operably linked to the endogenous 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene. For example, an endogenous 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene which is "transcriptionally silent," e.g., not normally expressed, or expressed only at very low levels, can be activated by inserting a regulatory element which is capable of promoting the expression of a normally expressed gene product in that cell. Techniques such as targeted homologous recombinations, can be used to insert the heterologous DNA as described in, e.g., Chappel, U.S. Pat. No. 5,272,071; WO 91/06667, published in May 16, 1991.

Transgenic Animals

The invention provides non-human transgenic animals. Such animals are useful for studying the function and/or activity of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein and for identifying and/or evaluating modulators of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 activity. As used herein, a "transgenic animal" is a non-human animal, preferably a mammal, more preferably a rodent such as a rat or mouse, in which one or more of the cells of the animal includes a transgene. Other examples of transgenic animals include non-human primates, sheep, dogs, cows, goats, chickens, amphibians, and the like. A transgene is exogenous DNA or a rearrangement, e.g., a deletion of endogenous chromosomal DNA, which preferably is integrated into or occurs in the genome of the cells of a transgenic animal. A transgene can direct the expression of an encoded gene product in one or more cell types or tissues of the transgenic animal, other transgenes, e.g., a knockout, reduce expression. Thus, a transgenic animal can be one in which an endogenous 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene has been altered by, e.g., by homologous recombination between the endogenous gene and an exogenous DNA molecule introduced into a cell of the animal, e.g., an embryonic cell of the animal, prior to development of the animal.

Intronic sequences and polyadenylation signals can also be included in the transgene to increase the efficiency of expression of the transgene. A tissue-specific regulatory sequence(s) can be operably linked to a transgene of the invention to direct expression of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein to particular cells. A transgenic founder animal can be identified based upon the presence of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 transgene in its genome and/or expression of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 mRNA in tissues or cells of the animals. A transgenic founder animal can then be used to breed additional animals carrying the transgene. Moreover, transgenic animals carrying a transgene encoding a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein can further be bred to other transgenic animals carrying other transgenes.

13237, 18480, 2245, 16228, 7677, 26320, 46619, 33166, 16836, 46867, 21617, 55562, 39228, 62088, 46745, 23155, 21657, 42755, 32229, 22325, 46863 or 32252 proteins or polypeptides can be expressed in transgenic animals or plants, e.g., a nucleic acid encoding the protein or polypeptide can be introduced into the genome of an animal. In preferred embodiments the nucleic acid is placed under the control of a tissue specific promoter, e.g., a milk or egg specific promoter, and recovered from the milk or eggs produced by the animal. Suitable animals are mice, pigs, cows, goats, and sheep.

The invention also includes a population of cells from a transgenic animal, as discussed, e.g., below.

Uses

The nucleic acid molecules, proteins, protein homologs, and antibodies described herein can be used in one or more of the following methods: a) screening assays; b) predictive medicine (e.g., diagnostic assays, prognostic assays, monitoring clinical trials, and pharmacogenetics); and c) methods of treatment (e.g., therapeutic and prophylactic).

The isolated nucleic acid molecules of the invention can be used, for example, to express a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein (e.g., via a recombinant expression vector in a host cell in gene therapy applications), to detect a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 mRNA (e.g., in a biological sample) or a genetic alteration in a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene, and to modulate 13237, 18480, 2245, 16228, 7677, 26320, 46619, 33166, 16836, 46867, 21617, 55562, 39228, 62088, 46745, 23155, 21657, 42755, 32229, 22325, 46863 or 32252 activity, as described further below. The 13237, 18480, 2245, 16228, 7677, 26320, 46619, 33166, 16836, 46867, 21617, 55562, 39228, 62088, 46745, 23155, 21657, 42755, 32229, 22325, 46863 or 32252 proteins can be used to treat disorders characterized by insufficient or excessive production of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 substrate or production of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 inhibitors. In addition, the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 proteins can be used to screen for naturally occurring 13237, 18480, 2245, 16228, 7677, 26320, 46619, 33166, 16836, 46867, 21617, 55562, 39228, 62088, 46745, 23155, 21657, 42755, 32229, 22325, 46863 or 32252 substrates, to screen for drugs or compounds which modulate 13237, 18480, 2245, 16228, 7677, 26320, 46619, 33166, 16836, 46867, 21617, 55562, 39228, 62088, 46745, 23155, 21657, 42755, 32229, 22325, 46863 or 32252 activity, as well as to treat disorders characterized by insufficient or excessive production of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein or production of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein forms which have decreased, aberrant or unwanted activity compared to 13237, 18480, 2245, 16228, 7677, 26320, 46619, 33166, 16836, 46867, 21617, 55562, 39228, 62088, 46745, 23155, 21657, 42755, 32229, 22325, 46863 or 32252 wild type protein (e.g., aberrant or deficient protein kinase activity, methyltransferase activity, acyl-CoA dehydrogenase activity, short chain dehyrdogenase activity, reductase activity, acyltransferase activity, phosphatase activity, transferase activity, ATP-ase activity, synthase activity, or other activity). Moreover, the anti-13237, 18480, 2245, 16228, 7677, 26320, 46619, 33166, 16836, 46867, 21617, 55562, 39228, 62088, 46745, 23155, 21657, 42755, 32229, 22325, 46863 or 32252 antibodies of the invention can be used to detect and isolate 13237, 18480, 2245, 16228, 7677, 26320, 46619, 33166, 16836, 46867, 21617, 55562, 39228, 62088, 46745, 23155, 21657, 42755, 32229, 22325, 46863 or 32252 proteins, regulate the bioavailability of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 proteins, and modulate 13237, 18480, 2245, 16228, 7677, 26320, 46619, 33166, 16836, 46867, 21617, 55562, 39228, 62088, 46745, 23155, 21657, 42755, 32229, 22325, 46863 or 32252 activity.

A method of evaluating a compound for the ability to interact with, e.g., bind, a subject 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptide is provided. The method includes: contacting the compound with the subject 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptide; and evaluating ability of the compound to interact with, e.g., to bind or form a complex with the subject 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptide. This method can be performed in vitro, e.g., in a cell free system, or in vivo, e.g., in a two-hybrid interaction trap assay. This method can be used to identify naturally occurring molecules which interact with subject 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptide. It can also be used to find natural or synthetic inhibitors of subject 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptide. Screening methods are discussed in more detail below.

Screening Assays:

The invention provides methods (also referred to herein as "screening assays") for identifying modulators, i.e., candidate or test compounds or agents (e.g., proteins, peptides, peptidomimetics, peptoids, small molecules or other drugs) which bind to 13237, 18480, 2245, 16228, 7677, 26320, 46619, 33166, 16836, 46867, 21617, 55562, 39228, 62088, 46745, 23155, 21657, 42755, 32229, 22325, 46863 or 32252 proteins, have a stimulatory or inhibitory effect on, for example, 13237, 18480, 2245, 16228, 7677, 26320, 46619, 33166, 16836, 46867, 21617, 55562, 39228, 62088, 46745, 23155, 21657, 42755, 32229, 22325, 46863 or 32252 expression or 13237, 18480, 2245, 16228, 7677, 26320, 46619, 33166, 16836, 46867, 21617, 55562, 39228, 62088, 46745, 23155, 21657, 42755, 32229, 22325, 46863 or 32252 activity, or have a stimulatory or inhibitory effect on, for example, the expression or activity of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 substrate. Compounds thus identified can be used to modulate the activity of target gene products (e.g., 13237, 18480, 2245, 16228, 7677, 26320, 46619, 33166, 16836, 46867, 21617, 55562, 39228, 62088, 46745, 23155, 21657, 42755, 32229, 22325, 46863 or 32252 genes) in a therapeutic protocol, to elaborate the biological function of the target gene product, or to identify compounds that disrupt normal target gene interactions.

In one embodiment, the invention provides assays for screening candidate or test compounds which are substrates of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein or polypeptide or a biologically active portion thereof. In another embodiment, the invention provides assays for screening candidate or test compounds which bind to or modulate the activity of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein or polypeptide or a biologically active portion thereof.

The test compounds of the present invention can be obtained using any of the numerous approaches in combinatorial library methods known in the art, including: biological libraries; peptoid libraries (libraries of molecules having the functionalities of peptides, but with a novel, non-peptide backbone which are resistant to enzymatic degradation but which nevertheless remain bioactive; see, e.g., Zuckermann et al. (1994) *J. Med. Chem.* 37:2678-85); spatially addressable parallel solid phase or solution phase libraries; synthetic library methods requiring deconvolution; the 'one-bead one-compound' library method; and synthetic library methods using affinity chromatography selection. The biological library and peptoid library approaches are limited to peptide libraries, while the other four approaches are applicable to peptide, non-peptide oligomer or small molecule libraries of compounds (Lam (1997) *Anticancer Drug Des.* 12:145).

Examples of methods for the synthesis of molecular libraries can be found in the art, for example in: DeWitt et al. (1993) *Proc. Natl. Acad. Sci. U.S.A.* 90:6909-13; Erb et al. (1994) *Proc. Natl. Acad. Sci. USA* 91:11422-426; Zuckermann et al. (1994). *J. Med. Chem.* 37:2678-85; Cho et al. (1993) *Science* 261:1303; Carrell et al. (1994) *Angew. Chem. Int. Ed. Engl.* 33:2059; Carell et al. (1994) *Angew. Chem. Int. Ed. Engl.* 33:2061; and in Gallop et al. (1994) *J. Med. Chem.* 37:1233-51.

Libraries of compounds can be presented in solution (e.g., Houghten (1992) *Biotechniques* 13:412-421), or on beads (Lam (1991) *Nature* 354:82-84), chips (Fodor (1993) *Nature* 364:555-556), bacteria (Ladner, U.S. Pat. No. 5,223,409), spores (Ladner U.S. Pat. No. '409), plasmids (Cull et al. (1992) *Proc Natl Acad Sci USA* 89:1865-1869) or on phage (Scott and Smith (1990) *Science* 249:386-390; Devlin (1990) *Science* 249:404-406; Cwirla et al. (1990) *Proc. Natl. Acad. Sci.* 87:6378-6382; Felici (1991) *J. Mol. Biol.* 222:301-310; Ladner supra.).

In one embodiment, an assay is a cell-based assay in which a cell which expresses a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein or biologically active portion thereof is contacted with a test compound, and the ability of the test compound to modulate 13237, 18480, 2245, 16228, 7677, 26320, 46619, 33166, 16836, 46867, 21617, 55562, 39228, 62088, 46745, 23155, 21657, 42755, 32229, 22325, 46863 or 32252 activity is determined. Determining the ability of the test compound to modulate 13237, 18480, 2245, 16228, 7677, 26320, 46619, 33166, 16836, 46867, 21617, 55562, 39228, 62088, 46745, 23155, 21657, 42755, 32229, 22325, 46863 or 32252 activity can be accomplished by monitoring, for example, protein kinase activity, methyltransferase activity, acyl-CoA dehydrogenase activity, short chain dehyrdogenase activity, reductase activity, acyltransferase activity, phosphatase activity, transferase activity, ATP-ase activity, synthase activity, or other activity. The cell, for example, can be of mammalian origin, e.g., human.

The ability of the test compound to modulate 13237, 18480, 2245, 16228, 7677, 26320, 46619, 33166, 16836, 46867, 21617, 55562, 39228, 62088, 46745, 23155, 21657, 42755, 32229, 22325, 46863 or 32252 binding to a compound, e.g., a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 substrate, or to bind to 13237, 18480, 2245, 16228, 7677, 26320, 46619, 33166, 16836, 46867, 21617, 55562, 39228, 62088, 46745, 23155, 21657, 42755, 32229, 22325, 46863 or 32252 can also be evaluated. This can be accomplished, for example, by coupling the compound, e.g., the substrate, with a radioisotope or enzymatic label such that binding of the compound, e.g., the substrate, to 13237, 18480, 2245, 16228, 7677, 26320, 46619, 33166, 16836, 46867, 21617, 55562, 39228, 62088, 46745, 23155, 21657, 42755, 32229, 22325, 46863 or 32252 can be determined by detecting the labeled compound, e.g., substrate, in a complex. Alternatively, 13237, 18480, 2245, 16228, 7677, 26320, 46619, 33166, 16836, 46867, 21617, 55562, 39228, 62088, 46745, 23155, 21657, 42755, 32229, 22325, 46863 or 32252 could be coupled with a radioisotope or enzymatic label to monitor the ability of a test compound to modulate 13237, 18480, 2245, 16228, 7677, 26320, 46619, 33166, 16836, 46867, 21617, 55562, 39228, 62088, 46745, 23155, 21657, 42755, 32229, 22325, 46863 or 32252 binding to a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 substrate in a complex. For example, compounds (e.g., 13237, 18480, 2245, 16228, 7677, 26320, 46619, 33166, 16836, 46867, 21617, 55562, 39228, 62088, 46745, 23155, 21657, 42755, 32229, 22325, 46863 or 32252 substrates) can be labeled with $^{125}$I, $^{14}$C, $^{35}$S or $^{3}$H, either directly or indirectly, and the radioisotope detected by direct counting of radioemmission or by scintillation counting. Alternatively, compounds can be enzymatically labeled with, for example, horseradish peroxidase, alkaline phosphatase, or luciferase, and the enzymatic label detected by determination of conversion of an appropriate substrate to product.

The ability of a compound (e.g., a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 substrate) to interact with 13237, 18480, 2245, 16228, 7677, 26320, 46619, 33166, 16836, 46867, 21617, 55562, 39228, 62088, 46745, 23155, 21657, 42755, 32229, 22325, 46863 or 32252 with or without the labeling of any of the interactants can be evaluated. For example, a microphysiometer can be used to detect the interaction of a compound with 13237, 18480, 2245, 16228, 7677, 26320, 46619, 33166, 16836, 46867, 21617, 55562, 39228, 62088, 46745, 23155, 21657, 42755, 32229, 22325, 46863 or 32252 without the labeling of either the compound or the 13237, 18480, 2245, 16228, 7677, 26320, 46619, 33166, 16836, 46867, 21617, 55562, 39228, 62088, 46745, 23155, 21657, 42755, 32229, 22325, 46863 or 32252. McConnell et al. (1992) *Science* 257:1906-1912. As used herein, a "microphysiometer" (e.g., Cytosensor) is an analytical instrument that measures the rate at which a cell acidifies its environment using a light-addressable potentiometric sensor (LAPS). Changes in this acidification rate can be used as an indicator of the interaction between a compound and 13237, 18480, 2245, 16228, 7677, 26320, 46619, 33166, 16836, 46867, 21617, 55562, 39228, 62088, 46745, 23155, 21657, 42755, 32229, 22325, 46863 or 32252.

In yet another embodiment, a cell-free assay is provided in which a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein or biologically active portion thereof is contacted with a test compound and the ability of the test compound to bind to the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein or biologically active portion thereof is evaluated. Preferred biologically active portions of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 proteins to be used in assays of the present invention include fragments which participate in interactions with non-13237, 18480, 2245, 16228, 7677, 26320, 46619, 33166, 16836, 46867, 21617, 55562, 39228, 62088, 46745, 23155, 21657, 42755, 32229, 22325, 46863 or 32252 molecules, e.g., fragments with high surface probability scores.

Soluble and/or membrane-bound forms of isolated proteins (e.g., 13237, 18480, 2245, 16228, 7677, 26320, 46619, 33166, 16836, 46867, 21617, 55562, 39228, 62088, 46745, 23155, 21657, 42755, 32229, 22325, 46863 or 32252 proteins or biologically active portions thereof) can be used in the cell-free assays of the invention. When membrane-bound forms of the protein are used, it may be desirable to utilize a solubilizing agent. Examples of such solubilizing agents include non-ionic detergents such as n-octylglucoside, n-dodecylglucoside, n-dodecylmaltoside, octanoyl-N-methylglucamide, decanoyl-N-methylglucamide, Triton® X-100, Triton® X-114, Thesit®, Isotridecypoly(ethylene glycol ether)$_n$, 3-[(3-cholamidopropyl)dimethylamminio]-1-propane sulfonate (CHAPS), 3-[(3-cholamidopropyl)dimethylamminio]-2-hydroxy-1-propane sulfonate (CHAPSO), or N-dodecyl=N,N-dimethyl-3-ammonio-1-propane sulfonate.

Cell-free assays involve preparing a reaction mixture of the target gene protein and the test compound under conditions and for a time sufficient to allow the two components to interact and bind, thus forming a complex that can be removed and/or detected.

The interaction between two molecules can also be detected, e.g., using fluorescence energy transfer (FET) (see, for example, Lakowicz et al., U.S. Pat. No. 5,631,169; Stavrianopoulos, et al., U.S. Pat. No. 4,868,103). A fluorophore label on the first, 'donor' molecule is selected such that its emitted fluorescent energy will be absorbed by a fluorescent label on a second, 'acceptor' molecule, which in turn is able to fluoresce due to the absorbed energy. Alternately, the 'donor' protein molecule can simply utilize the natural fluorescent energy of tryptophan residues. Labels are chosen that emit different wavelengths of light, such that the 'acceptor' molecule label can be differentiated from that of the 'donor'. Since the efficiency of energy transfer between the labels is related to the distance separating the molecules, the spatial relationship between the molecules can be assessed. In a situation in which binding occurs between the molecules, the fluorescent emission of the 'acceptor' molecule label in the assay should be maximal. An FET binding event can be conveniently measured through standard fluorometric detection means well known in the art (e.g., using a fluorimeter).

In another embodiment, determining the ability of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein to bind to a target molecule can be accomplished using real-time Biomolecular Interaction Analysis (BIA) (see, e.g., Sjolander and Urbaniczky (1991) *Anal. Chem.* 63:2338-2345 and Szabo et al. (1995) *Curr. Opin. Struct. Biol.* 5:699-705). "Surface plasmon resonance" or "BIA" detects biospecific interactions in real time, without labeling any of the interactants (e.g., BIAcore). Changes in the mass at the binding surface (indicative of a binding event) result in alterations of the refractive index of light near the surface (the optical phenomenon of surface plasmon resonance (SPR)), resulting in a detectable signal which can be used as an indication of real-time reactions between biological molecules.

In one embodiment, the target gene product or the test substance is anchored onto a solid phase. The target gene product/test compound complexes anchored on the solid phase can be detected at the end of the reaction. Preferably, the target gene product can be anchored onto a solid surface, and the test compound, (which is not anchored), can be labeled, either directly or indirectly, with detectable labels discussed herein.

It may be desirable to immobilize either 13237, 18480, 2245, 16228, 7677, 26320, 46619, 33166, 16836, 46867, 21617, 55562, 39228, 62088, 46745, 23155, 21657, 42755, 32229, 22325, 46863 or 32252, an anti-13237, 18480, 2245, 16228, 7677, 26320, 46619, 33166, 16836, 46867, 21617, 55562, 39228, 62088, 46745, 23155, 21657, 42755, 32229, 22325, 46863 or 32252 antibody or its target molecule to facilitate separation of complexed from uncomplexed forms of one or both of the proteins, as well as to accommodate automation of the assay. Binding of a test compound to a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein, or interaction of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein with a target molecule in the presence and absence of a candidate compound, can be accomplished in any vessel suitable for containing the reactants. Examples of such vessels include microtiter plates, test tubes, and micro-centrifuge tubes. In one embodiment, a fusion protein can be provided which adds a domain that allows one or both of the proteins to be bound to a matrix. For example, glutathione-S-transferase/ 13237, 18480, 2245, 16228, 7677, 26320, 46619, 33166, 16836, 46867, 21617, 55562, 39228, 62088, 46745, 23155, 21657, 42755, 32229, 22325, 46863 or 32252 fusion proteins or glutathione-S-transferase/target fusion proteins can be adsorbed onto glutathione sepharose beads (Sigma Chemical, St. Louis, Mo.) or glutathione derivatized microtiter plates, which are then combined with the test compound or the test compound and either the non-adsorbed target protein or 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein, and the mixture incubated under conditions conducive to complex formation (e.g., at physiological conditions for salt and pH).

Following incubation, the beads or microtiter plate wells are washed to remove any unbound components, the matrix immobilized in the case of beads, complex determined either directly or indirectly, for example, as described above. Alternatively, the complexes can be dissociated from the matrix, and the level of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 binding or activity determined using standard techniques.

Other techniques for immobilizing either a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein or a target molecule on matrices include using conjugation of biotin and streptavidin. Biotinylated 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein or target molecules can be prepared from biotin-NHS (N-hydroxy-succinimide) using techniques known in the art (e.g., biotinylation kit, Pierce Chemicals, Rockford, Ill.), and immobilized in the wells of streptavidin-coated 96 well plates (Pierce Chemical).

In order to conduct the assay, the non-immobilized component is added to the coated surface containing the anchored component. After the reaction is complete, unreacted components are removed (e.g., by washing) under conditions such that any complexes formed will remain immobilized on the solid surface. The detection of complexes anchored on the solid surface can be accomplished in a number of ways. Where the previously non-immobilized component is pre-labeled, the detection of label immobilized on the surface indicates that complexes were formed. Where the previously non-immobilized component is not pre-labeled, an indirect label can be used to detect complexes anchored on the surface; e.g., using a labeled antibody specific or selective for the immobilized component (the antibody, in turn, can be directly labeled or indirectly labeled with, e.g., a labeled anti-Ig antibody).

In one embodiment, this assay is performed utilizing antibodies reactive with 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein or target molecules but which do not interfere with binding of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein to its target molecule. Such antibodies can be derivatized to the wells of the plate, and unbound target or 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein trapped in the wells by antibody conjugation. Methods for detecting such complexes, in addition to those described above for the GST-immobilized complexes, include immunodetection of complexes using antibodies reactive with the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein or target molecule, as well as enzyme-linked assays which rely on detecting an enzymatic activity associated with the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein or target molecule.

Alternatively, cell free assays can be conducted in a liquid phase. In such an assay, the reaction products are separated from unreacted components, by any of a number of standard techniques, including but not limited to: differential centrifugation (see, for example, Rivas and Minton (1993) *Trends Biochem Sci* 18:284-7); chromatography (gel filtration chromatography, ion-exchange chromatography); electrophoresis (see, e.g., Ausubel et al., eds. (1999) *Current Protocols in Molecular Biology*, J. Wiley, New York.); and immunoprecipitation (see, for example, Ausubel et al., eds. (1999) *Current Protocols in Molecular Biology*, J. Wiley, New York). Such resins and chromatographic techniques are known to one skilled in the art (see, e.g., Heegaard (1998) *J Mol Recognit* 11:141-8; Hage and Tweed (1997) *J Chromatogr B Biomed Sci Appl.* 699:499-525). Further, fluorescence energy transfer can also be conveniently utilized, as described herein, to detect binding without further purification of the complex from solution.

In a preferred embodiment, the assay includes contacting the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein or biologically active portion thereof with a known compound which binds 13237, 18480, 2245, 16228, 7677, 26320, 46619, 33166, 16836, 46867, 21617, 55562, 39228, 62088, 46745, 23155, 21657, 42755, 32229, 22325, 46863 or 32252 to form an assay mixture, contacting the assay mixture with a test compound, and determining the ability of the test compound to interact with a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein, wherein determining the ability of the test compound to interact with a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein includes determining the ability of the test compound to preferentially bind to 13237, 18480, 2245, 16228, 7677, 26320, 46619, 33166, 16836, 46867, 21617, 55562, 39228, 62088, 46745, 23155, 21657, 42755, 32229, 22325, 46863 or 32252 or biologically active portion thereof, or to modulate the activity of a target molecule, as compared to the known compound.

The target gene products of the invention can, in vivo, interact with one or more cellular or extracellular macromolecules, such as proteins. For the purposes of this discussion, such cellular and extracellular macromolecules are referred to herein as "binding partners." Compounds that disrupt such interactions can be useful in regulating the activity of the target gene product. Such compounds can include, but are not limited to molecules such as antibodies, peptides, and small molecules. The preferred target genes/products for use in this embodiment are the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 genes herein identified. In an alternative embodiment, the invention provides methods for determining the ability of the test compound to modulate the activity of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein through modulation of the activity of a downstream effector of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 target molecule. For example, the activity of the effector molecule on an appropriate target can be determined, or the binding of the effector to an appropriate target can be determined, as previously described.

To identify compounds that interfere with the interaction between the target gene product and its cellular or extracellular binding partner(s), a reaction mixture containing the target gene product and the binding partner is prepared, under conditions and for a time sufficient, to allow the two products to form complex. In order to test an inhibitory agent, the reaction mixture is provided in the presence and absence of the test compound. The test compound can be initially included in the reaction mixture, or can be added at a time subsequent to the addition of the target gene and its cellular or extracellular binding partner. Control reaction mixtures are incubated without the test compound or with a placebo. The formation of any complexes between the target gene product and the cellular or extracellular binding partner is then detected. The formation of a complex in the control reaction, but not in the reaction mixture containing the test compound, indicates that the compound interferes with the interaction of the target gene product and the interactive binding partner.

Additionally, complex formation within reaction mixtures containing the test compound and normal target gene product can also be compared to complex formation within reaction mixtures containing the test compound and mutant target gene product. This comparison can be important in those cases wherein it is desirable to identify compounds that disrupt interactions of mutant but not normal target gene products.

These assays can be conducted in a heterogeneous or homogeneous format. Heterogeneous assays involve anchoring either the target gene product or the binding partner onto a solid phase, and detecting complexes anchored on the solid phase at the end of the reaction. In homogeneous assays, the entire reaction is carried out in a liquid phase. In either approach, the order of addition of reactants can be varied to obtain different information about the compounds being tested. For example, test compounds that interfere with the interaction between the target gene products and the binding partners, e.g., by competition, can be identified by conducting the reaction in the presence of the test substance. Alternatively, test compounds that disrupt preformed complexes, e.g., compounds with higher binding constants that displace one of the components from the complex, can be tested by adding the test compound to the reaction mixture after complexes have been formed. The various formats are briefly described below.

In a heterogeneous assay system, either the target gene product or the interactive cellular or extracellular binding partner, is anchored onto a solid surface (e.g., a microtiter plate), while the non-anchored species is labeled, either directly or indirectly. The anchored species can be immobilized by non-covalent or covalent attachments. Alternatively, an immobilized antibody specific or selective for the species to be anchored can be used to anchor the species to the solid surface.

In order to conduct the assay, the partner of the immobilized species is exposed to the coated surface with or without the test compound. After the reaction is complete, unreacted components are removed (e.g., by washing) and any complexes formed will remain immobilized on the solid surface. Where the non-immobilized species is pre-labeled, the detection of label immobilized on the surface indicates that complexes were formed. Where the non-immobilized species is not pre-labeled, an indirect label can be used to detect complexes anchored on the surface; e.g., using a labeled antibody specific or selective for the initially non-immobilized species (the antibody, in turn, can be directly labeled or indirectly labeled with, e.g., a labeled anti-Ig antibody). Depending upon the order of addition of reaction components, test compounds that inhibit complex formation or that disrupt preformed complexes can be detected.

Alternatively, the reaction can be conducted in a liquid phase in the presence or absence of the test compound, the reaction products separated from unreacted components, and complexes detected; e.g., using an immobilized antibody specific or selective for one of the binding components to anchor any complexes formed in solution, and a labeled antibody specific or selective for the other partner to detect anchored complexes. Again, depending upon the order of addition of reactants to the liquid phase, test compounds that inhibit complex or that disrupt preformed complexes can be identified.

In an alternate embodiment of the invention, a homogeneous assay can be used. For example, a preformed complex of the target gene product and the interactive cellular or extracellular binding partner product is prepared in that either the target gene products or their binding partners are labeled, but the signal generated by the label is quenched due to complex formation (see, e.g., U.S. Pat. No. 4,109,496 that utilizes this approach for immunoassays). The addition of a test substance that competes with and displaces one of the species from the preformed complex will result in the generation of a signal above background. In this way, test substances that disrupt target gene product-binding partner interaction can be identified.

In yet another aspect, the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 proteins can be used as "bait proteins" in a two-hybrid assay or three-hybrid assay (see, e.g., U.S. Pat. No. 5,283,317; Zervos et al. (1993) *Cell* 72:223-232; Madura et al. (1993) *J. Biol. Chem.* 268:12046-12054; Bartel et al. (1993) *Biotechniques* 14:920-924; Iwabuchi et al. (1993) *Oncogene* 8:1693-1696; and Brent WO94/10300), to identify other proteins, which bind to or interact with 13237, 18480, 2245, 16228, 7677, 26320, 46619, 33166, 16836, 46867, 21617, 55562, 39228, 62088, 46745, 23155, 21657, 42755, 32229, 22325, 46863 or 32252 ("13237, 18480, 2245, 16228, 7677, 26320, 46619, 33166, 16836, 46867, 21617, 55562, 39228, 62088, 46745, 23155, 21657, 42755, 32229, 22325, 46863 or 32252-binding proteins" or "13237, 18480, 2245, 16228, 7677, 26320, 46619, 33166, 16836, 46867, 21617, 55562, 39228, 62088, 46745, 23155, 21657, 42755, 32229, 22325, 46863 or 32252-bp") and are involved in 13237, 18480, 2245, 16228, 7677, 26320, 46619, 33166, 16836, 46867, 21617, 55562, 39228, 62088, 46745, 23155, 21657, 42755, 32229, 22325, 46863 or 32252 activity. Such 13237, 18480, 2245, 16228, 7677, 26320, 46619, 33166, 16836, 46867, 21617, 55562, 39228, 62088, 46745, 23155, 21657, 42755, 32229, 22325, 46863 or 32252-bps can be activators or inhibitors of signals by the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 proteins or 13237, 18480, 2245, 16228, 7677, 26320, 46619, 33166, 16836, 46867, 21617, 55562, 39228, 62088, 46745, 23155, 21657, 42755, 32229, 22325, 46863 or 32252 targets as, for example, downstream elements of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252-mediated signaling pathway.

The two-hybrid system is based on the modular nature of most transcription factors, which consist of separable DNA-binding and activation domains. Briefly, the assay utilizes two different DNA constructs. In one construct, the gene that codes for a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein is fused to a gene encoding the DNA binding domain of a known transcription factor (e.g., GAL-4). In the other construct, a DNA sequence, from a library of DNA sequences, that encodes an unidentified protein ("prey" or "sample") is fused to a gene that codes for the activation domain of the known transcription factor. (Alternatively the: 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein can be the fused to the activator domain.) If the "bait" and the "prey" proteins are able to interact, in vivo, forming a 13237, 18480, 2245, 16228, 7677, 26320, 46619, 33166, 16836, 46867, 21617, 55562, 39228, 62088, 46745, 23155, 21657, 42755, 32229, 22325, 46863 or 32252-dependent complex, the DNA-binding and activation domains of the transcription factor are brought into close proximity. This proximity allows transcription of a reporter gene (e.g., lacZ) which is operably linked to a transcriptional regulatory site responsive to the transcription factor. Expression of the reporter gene can be detected and cell colonies containing the functional transcription factor can be isolated and used to obtain the cloned gene which encodes the protein which interacts with the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein.

In another embodiment, modulators of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 expression are identified. For example, a cell or cell free mixture is contacted with a candidate compound and the expression of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 mRNA or protein evaluated relative to the level of expression of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 mRNA or protein in the absence of the candidate compound. When expression of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 mRNA or protein is greater in the presence of the candidate compound than in its absence, the candidate compound is identified as a stimulator of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 mRNA or protein expression. Alternatively, when expression of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 mRNA or protein is less (statistically significantly less) in the presence of the candidate compound than in its absence, the candidate compound is identified as an inhibitor of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 mRNA or protein expression. The level of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 mRNA or protein expression can be determined by methods described herein for detecting 13237, 18480, 2245, 16228, 7677, 26320, 46619, 33166, 16836, 46867, 21617, 55562, 39228, 62088, 46745, 23155, 21657, 42755, 32229, 22325, 46863 or 32252 mRNA or protein.

In another aspect, the invention pertains to a combination of two or more of the assays described herein. For example, a modulating agent can be identified using a cell-based or a cell free assay, and the ability of the agent to modulate the activity of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein can be confirmed in vivo, e.g., in an animal such as an animal model for aberrant or deficient protein kinase activity, methyltransferase activity, acyl-CoA dehydrogenase activity, short chain dehyrdogenase activity, reductase activity, acyltransferase activity, phosphatase activity, transferase activity, ATP-ase activity or synthase activity.

This invention further pertains to novel agents identified by the above-described screening assays. Accordingly, it is within the scope of this invention to further use an agent identified as described herein (e.g., a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 modulating agent, an antisense 13237, 18480, 2245, 16228, 7677, 26320, 46619, 33166, 16836, 46867, 21617, 55562, 39228, 62088, 46745, 23155, 21657, 42755, 32229, 22325, 46863 or 32252 nucleic acid molecule, a 13237, 18480, 2245, 16228, 7677, 26320, 46619, 33166, 16836, 46867, 21617, 55562, 39228, 62088, 46745, 23155, 21657, 42755, 32229, 22325, 46863 or 32252-specific antibody, or a 13237, 18480, 2245, 16228, 7677, 26320, 46619, 33166, 16836, 46867, 21617, 55562, 39228, 62088, 46745, 23155, 21657, 42755, 32229, 22325, 46863 or 32252-binding partner) in an appropriate animal model to determine the efficacy, toxicity, side effects, or mechanism of action, of treatment with such an agent. Furthermore, novel agents identified by the above-described screening assays can be used for treatments as described herein.

Detection Assays

Portions or fragments of the nucleic acid sequences identified herein can be used as polynucleotide reagents. For example, these sequences can be used to: (i) map their respective genes on a chromosome e.g., to locate gene regions associated with genetic disease or to associate 13237, 18480, 2245, 16228, 7677, 26320, 46619, 33166, 16836, 46867, 21617, 55562, 39228, 62088, 46745, 23155, 21657, 42755, 32229, 22325, 46863 or 32252 with a disease; (ii) identify an individual from a minute biological sample (tissue typing);

and (iii) aid in forensic identification of a biological sample. These applications are described in the subsections below.

Chromosome Mapping

The 13237, 18480, 2245, 16228, 7677, 26320, 46619, 33166, 16836, 46867, 21617, 55562, 39228, 62088, 46745, 23155, 21657, 42755, 32229, 22325, 46863 or 32252 nucleotide sequences or portions thereof can be used to map the location of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 genes on a chromosome. This process is called chromosome mapping. Chromosome mapping is useful in correlating the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 sequences with genes associated with disease.

Briefly, 13237, 18480, 2245, 16228, 7677, 26320, 46619, 33166, 16836, 46867, 21617, 55562, 39228, 62088, 46745, 23155, 21657, 42755, 32229, 22325, 46863 or 32252 genes can be mapped to chromosomes by preparing PCR primers (preferably 15-25 bp in length) from the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 nucleotide sequences. These primers can then be used for PCR screening of somatic cell hybrids containing individual human chromosomes. Only those hybrids containing the human gene corresponding to the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 sequences will yield an amplified fragment.

A panel of somatic cell hybrids in which each cell line contains either a single human chromosome or a small number of human chromosomes, and a full set of mouse chromosomes, can allow easy mapping of individual genes to specific human chromosomes. (D'Eustachio et al. (1983) *Science* 220:919-924).

Other mapping strategies e.g., in situ hybridization (described in Fan et al. (1990) *Proc. Natl. Acad. Sci. USA*, 87:6223-27), pre-screening with labeled flow-sorted chromosomes, and pre-selection by hybridization to chromosome specific cDNA libraries can be used to map 13237, 18480, 2245, 16228, 7677, 26320, 46619, 33166, 16836, 46867, 21617, 55562, 39228, 62088, 46745, 23155, 21657, 42755, 32229, 22325, 46863 or 32252 to a chromosomal location.

Fluorescence in situ hybridization (FISH) of a DNA sequence to a metaphase chromosomal spread can further be used to provide a precise chromosomal location in one step. The FISH technique can be used with a DNA sequence as short as 500 or 600 bases. However, clones larger than 1,000 bases have a higher likelihood of binding to a unique chromosomal location with sufficient signal intensity for simple detection. Preferably 1,000 bases, and more preferably 2,000 bases will suffice to get good results at a reasonable amount of time. For a review of this technique, see Verma et al. (1988) Human Chromosomes: A Manual of Basic Techniques, Pergamon Press, New York).

Reagents for chromosome mapping can be used individually to mark a single chromosome or a single site on that chromosome, or panels of reagents can be used for marking multiple sites and/or multiple chromosomes. Reagents corresponding to noncoding regions of the genes actually are preferred for mapping purposes. Coding sequences are more likely to be conserved within gene families, thus increasing the chance of cross hybridizations during chromosomal mapping.

Once a sequence has been mapped to a precise chromosomal location, the physical position of the sequence on the chromosome can be correlated with genetic map data. (Such data are found, for example, in McKusick, *Mendelian Inheritance in Man*, available on-line through Johns Hopkins University Welch Medical Library). The relationship between a gene and a disease, mapped to the same chromosomal region, can then be identified through linkage analysis (co-inheritance of physically adjacent genes), described in, for example, Egeland et al. (1987) *Nature*, 325:783-787.

Moreover, differences in the DNA sequences between individuals affected and unaffected with a disease associated with the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene, can be determined. If a mutation is observed in some or all of the affected individuals but not in any unaffected individuals, then the mutation is likely to be the causative agent of the particular disease. Comparison of affected and unaffected individuals generally involves first looking for structural alterations in the chromosomes, such as deletions or translocations that are visible from chromosome spreads or detectable using PCR based on that DNA sequence. Ultimately, complete sequencing of genes from several individuals can be performed to confirm the presence of a mutation and to distinguish mutations from polymorphisms.

Tissue Typing 13237, 18480, 2245, 16228, 7677, 26320, 46619, 33166, 16836, 46867, 21617, 55562, 39228, 62088, 46745, 23155, 21657, 42755, 32229, 22325, 46863 or 32252 sequences can be used to identify individuals from biological samples using, e.g., restriction fragment length polymorphism (RFLP). In this technique, an individual's genomic DNA is digested with one or more restriction enzymes, the fragments separated, e.g., in a Southern blot, and probed to yield bands for identification. The sequences of the present invention are useful as additional DNA markers for RFLP (described in U.S. Pat. No. 5,272,057).

Furthermore, the sequences of the present invention can also be used to determine the actual base-by-base DNA sequence of selected portions of an individual's genome. Thus, the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 nucleotide sequences described herein can be used to prepare two PCR primers from the 5' and 3' ends of the sequences. These primers can then be used to amplify an individual's DNA and subsequently sequence it. Panels of corresponding DNA sequences from individuals, prepared in this manner, can provide unique individual identifications, as each individual will have a unique set of such DNA sequences due to allelic differences.

Allelic variation occurs to some degree in the coding regions of these sequences, and to a greater degree in the noncoding regions. Each of the sequences described herein can, to some degree, be used as a standard against which DNA from an individual can be compared for identification purposes. Because greater numbers of polymorphisms occur in the noncoding regions, fewer sequences are necessary to differentiate individuals. The noncoding sequences of SEQ ID NO:1, 4, 7, 10, 39, 54, 59, 63, 66, 75, 79, 82, 89, 92, 95, 107, 112, 117, 120, 127, 139 or 151 can provide positive individual identification with a panel of perhaps 10 to 1,000 primers which each yield a noncoding amplified sequence of 100 bases. If predicted coding sequences, such as those in SEQ ID NO:3, 6, 9, 12, 41, 56, 58, 61, 65, 68, 77, 81, 84, 91, 94, 97, 109, 114, 119, 122, 129, 141 or 153 are used, a more appropriate number of primers for positive individual identification would be 500-2,000.

If a panel of reagents from 13237, 18480, 2245, 16228, 7677, 26320, 46619, 33166, 16836, 46867, 21617, 55562, 39228, 62088, 46745, 23155, 21657, 42755, 32229, 22325, 46863 or 32252 nucleotide sequences described herein is used to generate a unique identification database for an individual, those same reagents can later be used to identify tissue from that individual. Using the unique identification database, positive identification of the individual, living or dead, can be made from extremely small tissue samples.

Use of Partial 13237, 18480, 2245, 16228, 7677, 26320, 46619, 33166, 16836, 46867, 21617, 55562, 39228, 62088, 46745, 23155, 21657, 42755, 32229, 22325, 46863 or 32252 Sequences in Forensic Biology DNA-based identification techniques can also be used in forensic biology. To make such an identification, PCR technology can be used to amplify DNA sequences taken from very small biological samples such as tissues, e.g., hair or skin, or body fluids, e.g., blood, saliva, or semen found at a crime scene. The amplified sequence can then be compared to a standard, thereby allowing identification of the origin of the biological sample.

The sequences of the present invention can be used to provide polynucleotide reagents, e.g., PCR primers, targeted to specific loci in the human genome, which can enhance the reliability of DNA-based forensic identifications by, for example, providing another "identification marker" (i.e. another DNA sequence that is unique to a particular individual). As mentioned above, actual base sequence information can be used for identification as an accurate alternative to patterns formed by restriction enzyme generated fragments. Sequences targeted to noncoding regions of SEQ ID NO:1, 4, 7, 10, 39, 54, 59, 63, 66, 75, 79, 82, 89, 92, 95, 107, 112, 117, 120, 127, 139 or 151 (e.g., fragments derived from the noncoding regions of SEQ ID NO:1, 4, 7, 10, 39, 54, 59, 63, 66, 75, 79, 82, 89, 92, 95, 107, 112, 117, 120, 127, 139 or 151 having a length of at least 20 bases, preferably at least 30 bases) are particularly appropriate for this use.

The 13237, 18480, 2245, 16228, 7677, 26320, 46619, 33166, 16836, 46867, 21617, 55562, 39228, 62088, 46745, 23155, 21657, 42755, 32229, 22325, 46863 or 32252 nucleotide sequences described herein can further be used to provide polynucleotide reagents, e.g., labeled or labelable probes which can be used in, for example, an in situ hybridization technique, to identify a specific tissue. This can be very useful in cases where a forensic pathologist is presented with a tissue of unknown origin. Panels of such 13237, 18480, 2245, 16228, 7677, 26320, 46619, 33166, 16836, 46867, 21617, 55562, 39228, 62088, 46745, 23155, 21657, 42755, 32229, 22325, 46863 or 32252 probes can be used to identify tissue by species and/or by organ type.

In a similar fashion, these reagents, e.g., 13237, 18480, 2245, 16228, 7677, 26320, 46619, 33166, 16836, 46867, 21617, 55562, 39228, 62088, 46745, 23155, 21657, 42755, 32229, 22325, 46863 or 32252 primers or probes can be used to screen tissue culture for contamination (i.e. screen for the presence of a mixture of different types of cells in a culture).

Predictive Medicine

The present invention also pertains to the field of predictive medicine in which diagnostic assays, prognostic assays, and monitoring clinical trials are used for prognostic (predictive) purposes to thereby treat an individual.

Generally, the invention provides a method of determining if a subject is at risk for a disorder related to a lesion in or the misexpression of a gene which encodes 13237, 18480, 2245, 16228, 7677, 26320, 46619, 33166, 16836, 46867, 21617, 55562, 39228, 62088, 46745, 23155, 21657, 42755, 32229, 22325, 46863 or 32252.

Such disorders include, e.g., a disorder associated with the misexpression of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene; a cellular proliferation or differentiation disorder, a cardiovascular, endothelial, breast, lung, colon, prostate, skin, pancreas, brain, blood vessel, platelet, bone, immune, metabolic, kidney, ovarian, viral, pain, liver, hematopoietic, skeletal muscle testicular, eye or hormonal disorder.

The method includes one or more of the following: detecting, in a tissue of the subject, the presence or absence of a mutation which affects the expression of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene, or detecting the presence or absence of a mutation in a region which controls the expression of the gene, e.g., a mutation in the 5' control region; detecting, in a tissue of the subject, the presence or absence of a mutation which alters the structure of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene; detecting, in a tissue of the subject, the misexpression of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene, at the mRNA level, e.g., detecting a non-wild type level of an mRNA; or detecting, in a tissue of the subject, the misexpression of the gene, at the protein level, e.g., detecting a non-wild type level of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptide.

In preferred embodiments the method includes: ascertaining the existence of at least one of: a deletion of one or more nucleotides from the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene; an insertion of one or more nucleotides into the gene, a point mutation, e.g., a substitution of one or more nucleotides of the gene, a gross chromosomal rearrangement of the gene, e.g., a translocation, inversion, or deletion.

For example, detecting the genetic lesion can include: (i) providing a probe/primer including an oligonucleotide containing a region of nucleotide sequence which hybridizes to a sense or antisense sequence from SEQ ID NO:1, 4, 7, 10, 39, 54, 59, 63, 66, 75, 79, 82, 89, 92, 95, 107, 112, 117, 120, 127, 139 or 151, or naturally occurring mutants thereof or 5' or 3' flanking sequences naturally associated with the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene; (ii) exposing the probe/primer to nucleic acid of the tissue; and detecting, by hybridization, e.g., in situ hybridization, of the probe/primer to the nucleic acid, the presence or absence of the genetic lesion.

In preferred embodiments detecting the misexpression includes ascertaining the existence of at least one of: an alteration in the level of a messenger RNA transcript of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene; the presence of a non-wild type splicing pattern of a messenger RNA transcript of the gene; or a non-wild type level of 13237, 18480, 2245, 16228, 7677, 26320, 46619, 33166, 16836, 46867, 21617, 55562, 39228, 62088, 46745, 23155, 21657, 42755, 32229, 22325, 46863 or 32252.

Methods of the invention can be used prenatally or to determine if a subject's offspring will be at risk for a disorder.

In preferred embodiments the method includes determining the structure of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene, an abnormal structure being indicative of risk for the disorder.

In preferred embodiments the method includes contacting a sample from the subject with an antibody to the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein or a nucleic acid, which hybridizes specifically with the gene. These and other embodiments are discussed below.

Diagnostic and Prognostic Assays

The presence, level, or absence of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein or nucleic acid in a biological sample can be evaluated by obtaining a biological sample from a test subject and contacting the biological sample with a compound or an agent capable of detecting 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein or nucleic acid (e.g., mRNA, genomic DNA) that encodes 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein such that the presence of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein or nucleic acid is detected in the biological sample. The term "biological sample" includes tissues, cells and biological fluids isolated from a subject, as well as tissues, cells and fluids present within a subject. A preferred biological sample is serum. The level of expression of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene can be measured in a number of ways, including, but not limited to: measuring the mRNA encoded by the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 genes; measuring the amount of protein encoded by the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 genes; or measuring the activity of the protein encoded by the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 genes.

The level of mRNA corresponding to the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene in a cell can be determined both by in situ and by in vitro formats.

The isolated mRNA can be used in hybridization or amplification assays that include, but are not limited to, Southern or Northern analyses, polymerase chain reaction analyses and probe arrays. One preferred diagnostic method for the detection of mRNA levels involves contacting the isolated mRNA with a nucleic acid molecule (probe) that can hybridize to the mRNA encoded by the gene being detected. The nucleic acid probe can be, for example, a full-length 13237, 18480, 2245, 16228, 7677, 26320, 46619, 33166, 16836, 46867, 21617, 55562, 39228, 62088, 46745, 23155, 21657, 42755, 32229, 22325, 46863 or 32252 nucleic acid, such as the nucleic acid of SEQ ID NO:1, 4, 7, 10, 39, 54, 59, 63, 66, 75, 79, 82, 89, 92, 95, 107, 112, 117, 120, 127, 139 or 151, or a portion thereof, such as an oligonucleotide of at least 7, 15, 30, 50, 100, 250 or 500 nucleotides in length and sufficient to specifically hybridize under stringent conditions to 13237, 18480, 2245, 16228, 7677, 26320, 46619, 33166, 16836, 46867, 21617, 55562, 39228, 62088, 46745, 23155, 21657, 42755, 32229, 22325, 46863 or 32252 mRNA or genomic DNA. Other suitable probes for use in the diagnostic assays are described herein.

In one format, mRNA (or cDNA) is immobilized on a surface and contacted with the probes, for example by running the isolated mRNA on an agarose gel and transferring the mRNA from the gel to a membrane, such as nitrocellulose. In an alternative format, the probes are immobilized on a surface and the mRNA (or cDNA) is contacted with the probes, for example, in a two-dimensional gene chip array. A skilled artisan can adapt known mRNA detection methods for use in detecting the level of mRNA encoded by the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 genes.

The level of mRNA in a sample that is encoded by one of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 can be evaluated with nucleic acid amplification, e.g., by rtPCR (Mullis (1987) U.S. Pat. No. 4,683,202), ligase chain reaction (Barany (1991) *Proc. Natl. Acad. Sci. USA* 88:189-193), self sustained sequence replication (Guatelli et al., (1990) *Proc. Natl. Acad. Sci. USA* 87:1874-1878), transcriptional amplification system (Kwoh et al., (1989), *Proc. Natl. Acad. Sci. USA* 86:1173-1177), Q-Beta Replicase (Lizardi et al., (1988) *Bio/Technology* 6:1197), rolling circle replication (Lizardi et al., U.S. Pat. No. 5,854,033) or any other nucleic acid amplification method, followed by the detection of the amplified molecules using techniques known in the art. As used herein, amplification primers are defined as being a pair of nucleic acid molecules that can anneal to 5' or 3' regions of a gene (plus and minus strands, respectively, or vice-versa) and contain a short region in between. In general, amplification primers are from about 10 to 30 nucleotides in length and flank a region from about 50 to 200 nucleotides in length. Under appropriate conditions and with appropriate reagents, such primers permit the amplification of a nucleic acid molecule comprising the nucleotide sequence flanked by the primers.

For in situ methods, a cell or tissue sample can be prepared/processed and immobilized on a support, typically a glass slide, and then contacted with a probe that can hybridize to mRNA that encodes the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene being analyzed.

In another embodiment, the methods further contacting a control sample with a compound or agent capable of detecting 13237, 18480, 2245, 16228, 7677, 26320, 46619, 33166, 16836, 46867, 21617, 55562, 39228, 62088, 46745, 23155, 21657, 42755, 32229, 22325, 46863 or 32252 mRNA, or genomic DNA, and comparing the presence of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 mRNA or genomic DNA in the control sample with the presence of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 mRNA or genomic DNA in the test sample.

A variety of methods can be used to determine the level of protein encoded by 13237, 18480, 2245, 16228, 7677, 26320, 46619, 33166, 16836, 46867, 21617, 55562, 39228, 62088, 46745, 23155, 21657, 42755, 32229, 22325, 46863 or 32252. In general, these methods include contacting an agent that selectively binds to the protein, such as an antibody with a sample, to evaluate the level of protein in the sample. In a preferred embodiment, the antibody bears a detectable label. Antibodies can be polyclonal, or more preferably, monoclonal. An intact antibody, or a fragment thereof (e.g., Fab or F(ab')$_2$) can be used. The term "labeled", with regard to the probe or antibody, is intended to encompass direct labeling of the probe or antibody by coupling (i.e., physically linking) a detectable substance to the probe or antibody, as well as indirect labeling of the probe or antibody by reactivity with a detectable substance. Examples of detectable substances are provided herein.

The detection methods can be used to detect 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein in a biological sample in vitro as well as in vivo. In vitro techniques for detection of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein include enzyme linked immunosorbent assays (ELISAs), immunoprecipitations, immunofluorescence, enzyme immunoassay (EIA), radioimmunoassay (RIA), and Western blot analysis. In vivo techniques for detection of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein include introducing into a subject a labeled anti-13237, 18480, 2245, 16228, 7677, 26320, 46619, 33166, 16836, 46867, 21617, 55562, 39228, 62088, 46745, 23155, 21657, 42755, 32229, 22325, 46863 or 32252 antibody. For example, the antibody can be labeled with a radioactive marker whose presence and location in a subject can be detected by standard imaging techniques.

In another embodiment, the methods further include contacting the control sample with a compound or agent capable of detecting 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein, and comparing the presence of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein in the control sample with the presence of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein in the test sample.

The invention also includes kits for detecting the presence of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 in a biological sample. For example, the kit can include a compound or agent capable of detecting 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein or mRNA in a biological sample; and a standard. The compound or agent can be packaged in a suitable container. The kit can further comprise instructions for using the kit to detect 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein or nucleic acid.

For antibody-based kits, the kit can include: (1) a first antibody (e.g., attached to a solid support) which binds to a polypeptide corresponding to a marker of the invention; and, optionally, (2) a second, different antibody which binds to either the polypeptide or the first antibody and is conjugated to a detectable agent.

For oligonucleotide-based kits, the kit can include: (1) an oligonucleotide, e.g., a detectably labeled oligonucleotide, which hybridizes to a nucleic acid sequence encoding a polypeptide corresponding to a marker of the invention or (2) a pair of primers useful for amplifying a nucleic acid molecule corresponding to a marker of the invention. The kit can also includes a buffering agent, a preservative, or a protein stabilizing agent. The kit can also includes components necessary for detecting the detectable agent (e.g., an enzyme or a substrate). The kit can also contain a control sample or a series of control samples which can be assayed and compared to the test sample contained. Each component of the kit can be enclosed within an individual container and all of the various containers can be within a single package, along with instructions for interpreting the results of the assays performed using the kit.

The diagnostic methods described herein can identify subjects having, or at risk of developing, a disease or disorder associated with misexpressed or aberrant or unwanted 13237, 18480, 2245, 16228, 7677, 26320, 46619, 33166, 16836, 46867, 21617, 55562, 39228, 62088, 46745, 23155, 21657, 42755, 32229, 22325, 46863 or 32252 expression or activity. As used herein, the term "unwanted" includes an unwanted phenomenon involved in a biological response such as pain or deregulated cell proliferation.

In one embodiment, a disease or disorder associated with aberrant or unwanted 13237, 18480, 2245, 16228, 7677, 26320, 46619, 33166, 16836, 46867, 21617, 55562, 39228, 62088, 46745, 23155, 21657, 42755, 32229, 22325, 46863 or 32252 expression or activity is identified. A test sample is obtained from a subject and 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein or nucleic acid (e.g., mRNA or genomic DNA) is evaluated, wherein the level, e.g., the presence or absence, of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein or nucleic acid is diagnostic for a subject having or at risk of developing a disease or disorder associated with aberrant or unwanted 13237, 18480, 2245, 16228, 7677, 26320, 46619, 33166, 16836, 46867, 21617, 55562, 39228, 62088, 46745, 23155, 21657, 42755, 32229, 22325, 46863 or 32252 expression or activity. As used herein, a "test sample" refers to a biological sample obtained from a subject of interest, including a biological fluid (e.g., serum), cell sample, or tissue.

The prognostic assays described herein can be used to determine whether a subject can be administered an agent (e.g., an agonist, antagonist, peptidomimetic, protein, peptide, nucleic acid, small molecule, or other drug candidate) to treat a disease or disorder associated with aberrant or unwanted 13237, 18480, 2245, 16228, 7677, 26320, 46619, 33166, 16836, 46867, 21617, 55562, 39228, 62088, 46745, 23155, 21657, 42755, 32229, 22325, 46863 or 32252 expression or activity. For example, such methods can be used to determine whether a subject can be effectively treated with an agent for a cellular proliferation or differentiation disorder, a cardiovascular, endothelial, breast, lung, colon, prostate, skin, pancreas, brain, blood vessel, platelet, bone, immune, metabolic, kidney, ovarian, viral, pain, liver, hematopoietic, skeletal muscle testicular, eye or hormonal disorder.

The methods of the invention can also be used to detect genetic alterations in a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene, thereby determining if a subject with the altered gene is at risk for a disorder characterized by misregulation in 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein activity or nucleic acid expression, such as a a cellular proliferation or differentiation disorder, a cardiovascular, endothelial, breast, lung, colon, prostate, skin, pancreas, brain, blood vessel, platelet, bone, immune, metabolic, kidney, ovarian, viral, pain, liver, hematopoietic, skeletal muscle testicular, eye or hormonal disorder. In preferred embodiments, the methods include detecting, in a sample from the subject, the presence or absence of a genetic alteration characterized by at least one of an alteration affecting the integrity of a gene encoding a 13237, 18480, 2245, 16228, 7677, 26320, 46619, 33166, 16836, 46867, 21617, 55562, 39228, 62088, 46745, 23155, 21657, 42755, 32229, 22325, 46863 or 32252-protein, or the mis-expression of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene. For example, such genetic alterations can be detected by ascertaining the existence of at least one of 1) a deletion of one or more nucleotides from a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene; 2) an addition of one or more nucleotides to a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene; 3) a substitution of one or more nucleotides of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene, 4) a chromosomal rearrangement of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene; 5) an alteration in the level of a messenger RNA transcript of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene, 6) aberrant modification of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene, such as of the methylation pattern of the genomic DNA, 7) the presence of a non-wild type splicing pattern of a messenger RNA transcript of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene, 8) a non-wild type level of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252-protein, 9) allelic loss of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene, and 10) inappropriate post-translational modification of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252-protein.

An alteration can be detected without a probe/primer in a polymerase chain reaction, such as anchor PCR or RACE PCR, or, alternatively, in a ligation chain reaction (LCR), the latter of which can be particularly useful for detecting point mutations in the 13237, 18480, 2245, 16228, 7677, 26320, 46619, 33166, 16836, 46867, 21617, 55562, 39228, 62088, 46745, 23155, 21657, 42755, 32229, 22325, 46863 or 32252-gene. This method can include the steps of collecting a sample of cells from a subject, isolating nucleic acid (e.g., genomic, mRNA or both) from the sample, contacting the nucleic acid sample with one or more primers which specifically hybridize to a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene under conditions such that hybridization and amplification of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene (if present) occurs, and detecting the presence or absence of an amplification product, or detecting the size of the amplification product and comparing the length to a control sample. It is anticipated that PCR and/or LCR may be desirable to use as a preliminary amplification step in conjunction with any of the techniques used for detecting mutations described herein. Alternatively, other amplification methods described herein or known in the art can be used.

In another embodiment, mutations in a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene from a sample cell can be identified by detecting alterations in restriction enzyme cleavage patterns. For example, sample and control DNA is isolated, amplified (optionally), digested with one or more restriction endonucleases, and fragment length sizes are determined, e.g., by gel electrophoresis and compared. Differences in fragment length sizes between sample and control DNA indicates mutations in the sample DNA. Moreover, the use of sequence specific ribozymes (see, for example, U.S. Pat. No. 5,498,531) can be used to score for the presence of specific mutations by development or loss of a ribozyme cleavage site.

In other embodiments, genetic mutations in 13237, 18480, 2245, 16228, 7677, 26320, 46619, 33166, 16836, 46867, 21617, 55562, 39228, 62088, 46745, 23155, 21657, 42755, 32229, 22325, 46863 or 32252 can be identified by hybridizing a sample and control nucleic acids, e.g., DNA or RNA, two dimensional arrays, e.g., chip based arrays. Such arrays include a plurality of addresses, each of which is positionally distinguishable from the other. A different probe is located at each address of the plurality. The arrays can have a high density of addresses, e.g., can contain hundreds or thousands of oligonucleotides probes (Cronin et al. (1996) *Human Mutation* 7: 244-255; Kozal et al. (1996) *Nature Medicine* 2: 753-759). For example, genetic mutations in 13237, 18480, 2245, 16228, 7677, 26320, 46619, 33166, 16836, 46867, 21617, 55562, 39228, 62088, 46745, 23155, 21657, 42755, 32229, 22325, 46863 or 32252 can be identified in two dimensional arrays containing light-generated DNA probes as described in Cronin, M. T. et al. supra. Briefly, a first hybridization array of probes can be used to scan through long stretches of DNA in a sample and control to identify base changes between the sequences by making linear arrays of sequential overlapping probes. This step allows the identification of point mutations. This step is followed by a second hybridization array that allows the characterization of specific mutations by using smaller, specialized probe arrays complementary to all variants or mutations detected. Each mutation array is composed of parallel probe sets, one complementary to the wild-type gene and the other complementary to the mutant gene.

In yet another embodiment, any of a variety of sequencing reactions known in the art can be used to directly sequence the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene and detect mutations by comparing the sequence of the sample 13237, 18480, 2245, 16228, 7677, 26320, 46619, 33166, 16836, 46867, 21617, 55562, 39228, 62088, 46745, 23155, 21657, 42755, 32229, 22325, 46863 or 32252 with the corresponding wild-type (control) sequence. Automated sequencing procedures can be utilized when performing the diagnostic assays (Naeve et al. (1995) *Biotechniques* 19:448-53), including sequencing by mass spectrometry.

Other methods for detecting mutations in the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene include methods in which protection from cleavage agents is used to detect mismatched bases in RNA/RNA or RNA/DNA heteroduplexes (Myers et al. (1985) *Science* 230:1242; Cotton et al. (1988) *Proc. Natl. Acad Sci USA* 85:4397; Saleeba et al. (1992) *Methods Enzymol.* 217:286-295).

In still another embodiment, the mismatch cleavage reaction employs one or more proteins that recognize mismatched base pairs in double-stranded DNA (so called "DNA mismatch repair" enzymes) in defined systems for detecting and mapping point mutations in 13237, 18480, 2245, 16228, 7677, 26320, 46619, 33166, 16836, 46867, 21617, 55562, 39228, 62088, 46745, 23155, 21657, 42755, 32229, 22325, 46863 or 32252 cDNAs obtained from samples of cells. For example, the mutY enzyme of *E. coli* cleaves A at G/A mismatches and the thymidine DNA glycosylase from HeLa cells cleaves T at G/T mismatches (Hsu et al. (1994) *Carcinogenesis* 15:1657-1662; U.S. Pat. No. 5,459,039).

In other embodiments, alterations in electrophoretic mobility will be used to identify mutations in 13237, 18480, 2245, 16228, 7677, 26320, 46619, 33166, 16836, 46867, 21617, 55562, 39228, 62088, 46745, 23155, 21657, 42755, 32229, 22325, 46863 or 32252 genes. For example, single strand conformation polymorphism (SSCP) can be used to detect differences in electrophoretic mobility between mutant and wild type nucleic acids (Orita et al. (1989) *Proc Natl. Acad. Sci. USA:* 86:2766, see also Cotton (1993) *Mutat. Res.* 285:125-144; and Hayashi (1992) *Genet. Anal. Tech. Appl.* 9:73-79). Single-stranded DNA fragments of sample and control 13237, 18480, 2245, 16228, 7677, 26320, 46619, 33166, 16836, 46867, 21617, 55562, 39228, 62088, 46745, 23155, 21657, 42755, 32229, 22325, 46863 or 32252 nucleic acids will be denatured and allowed to renature. The secondary structure of single-stranded nucleic acids varies according to sequence, the resulting alteration in electrophoretic mobility enables the detection of even a single base change. The DNA fragments can be labeled or detected with labeled probes. The sensitivity of the assay can be enhanced by using RNA (rather than DNA), in which the secondary structure is more sensitive to a change in sequence. In a preferred embodiment, the subject method utilizes heteroduplex analysis to separate double stranded heteroduplex molecules on the basis of changes in electrophoretic mobility (Keen et al. (1991) *Trends Genet.* 7:5).

In yet another embodiment, the movement of mutant or wild-type fragments in polyacrylamide gels containing a gradient of denaturant is assayed using denaturing gradient gel electrophoresis (DGGE) (Myers et al. (1985) *Nature* 313: 495). When DGGE is used as the method of analysis, DNA will be modified to insure that it does not completely denature, for example by adding a GC clamp of approximately 40 bp of high-melting GC-rich DNA by PCR. In a further embodiment, a temperature gradient is used in place of a denaturing gradient to identify differences in the mobility of control and sample DNA (Rosenbaum and Reissner (1987) *Biophys Chem* 265:12753).

Examples of other techniques for detecting point mutations include, but are not limited to, selective oligonucleotide hybridization, selective amplification, or selective primer extension (Saiki et al. (1986) *Nature* 324:163); Saiki et al. (1989) *Proc. Natl. Acad. Sci. USA* 86:6230).

Alternatively, allele specific amplification technology which depends on selective PCR amplification can be used in conjunction with the instant invention. Oligonucleotides used as primers for specific amplification can carry the mutation of interest in the center of the molecule (so that amplification depends on differential hybridization) (Gibbs et al. (1989) *Nucleic Acids Res.* 17:2437-2448) or at the extreme 3' end of one primer where, under appropriate conditions, mismatch can prevent, or reduce polymerase extension (Prossner (1993) *Tibtech* 11:238). In addition it may be desirable to introduce a novel restriction site in the region of the mutation to create cleavage-based detection (Gasparini et al. (1992) *Mol. Cell. Probes* 6:1). It is anticipated that in certain embodiments amplification can also be performed using Taq ligase for amplification (Barany (1991) *Proc. Natl. Acad Sci USA* 88:189-93). In such cases, ligation will occur only if there is a perfect match at the 3' end of the 5' sequence making it possible to detect the presence of a known mutation at a specific site by looking for the presence or absence of amplification.

The methods described herein can be performed, for example, by utilizing pre-packaged diagnostic kits comprising at least one probe nucleic acid or antibody reagent described herein, which can be conveniently used, e.g., in clinical settings to diagnose patients exhibiting symptoms or family history of a disease or illness involving a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene.

Use of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 Molecules as Surrogate Markers The 13237, 18480, 2245, 16228, 7677, 26320, 46619, 33166, 16836, 46867, 21617, 55562, 39228, 62088, 46745, 23155, 21657, 42755, 32229, 22325, 46863 or 32252 molecules of the invention are also useful as markers of disorders or disease states, as markers for precursors of disease states, as markers for predisposition of disease states, as markers of drug activity, or as markers of the pharmacogenomic profile of a subject. Using the methods described herein, the presence, absence and/or quantity of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 molecules of the invention can be detected, and can be correlated with one or more biological states in vivo. For example, the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 molecules of the invention can serve as surrogate markers for one or more disorders or disease states or for conditions leading up to disease states. As used herein, a "surrogate marker" is an objective biochemical marker which correlates with the absence or presence of a disease or disorder, or with the progression of a disease or disorder (e.g., with the presence or absence of a tumor). The presence or quantity of such markers is independent of the disease. Therefore, these markers can serve to indicate whether a particular course of treatment is effective in lessening a disease state or disorder. Surrogate markers are of particular use when the presence or extent of a disease state or disorder is difficult to assess through standard methodologies (e.g., early stage tumors), or when an assessment of disease progression is desired before a potentially dangerous clinical endpoint is reached (e.g., an assessment of cardiovascular disease can be made using cholesterol levels as a surrogate marker, and an analysis of HIV infection can be made using HIV RNA levels as a surrogate marker, well in advance of the undesirable clinical outcomes of myocardial infarction or fully-developed AIDS). Examples of the use of surrogate markers in the art include: Koomen et al. (2000) *J. Mass. Spectrorn.* 35: 258-264; and James (1994) *AIDS Treatment News Archive* 209.

The 13237, 18480, 2245, 16228, 7677, 26320, 46619, 33166, 16836, 46867, 21617, 55562, 39228, 62088, 46745, 23155, 21657, 42755, 32229, 22325, 46863 or 32252 molecules of the invention are also useful as pharmacodynamic markers. As used herein, a "pharmacodynamic marker" is an objective biochemical marker which correlates specifically with drug effects. The presence or quantity of a pharmacodynamic marker is not related to the disease state or disorder for which the drug is being administered; therefore, the presence or quantity of the marker is indicative of the presence or activity of the drug in a subject. For example, a pharmacodynamic marker can be indicative of the concentration of the drug in a biological tissue, in that the marker is either expressed or transcribed or not expressed or transcribed in that tissue in relationship to the level of the drug. In this fashion, the distribution or uptake of the drug can be monitored by the pharmacodynamic marker. Similarly, the presence or quantity of the pharmacodynamic marker can be related to the presence or quantity of the metabolic product of a drug, such that the presence or quantity of the marker is indicative of the relative breakdown rate of the drug in vivo. Pharmacodynamic markers are of particular use in increasing the sensitivity of detection of drug effects, particularly when the drug is administered in low doses. Since even a small amount of a drug can be sufficient to activate multiple rounds of marker (e.g., a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 marker) transcription or expression, the amplified marker can be in a quantity which is more readily detectable than the drug itself. Also, the marker can be more easily detected due to the nature of the marker itself; for example, using the methods described herein, anti-13237, 18480, 2245, 16228, 7677, 26320, 46619, 33166, 16836, 46867, 21617, 55562, 39228, 62088, 46745, 23155, 21657, 42755, 32229, 22325, 46863 or 32252 antibodies can be employed in an immune-based detection system for a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein marker, or 13237, 18480, 2245, 16228, 7677, 26320, 46619, 33166, 16836, 46867, 21617, 55562, 39228, 62088, 46745, 23155, 21657, 42755, 32229, 22325, 46863 or 32252-specific radiolabeled probes can be used to detect a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 mRNA marker. Furthermore, the use of a pharmacodynamic marker can offer mechanism-based prediction of risk due to drug treatment beyond the range of possible direct observations. Examples of the use of pharmacodynamic markers in the art include: Matsuda et al. U.S. Pat. No. 6,033,862; Hattis et al. (1991) *Env. Health Perspect.* 90: 229-238; Schentag (1999) *Am. J. Health-Syst. Pharm.* 56 Suppl. 3: S21-S24; and Nicolau (1999) *Am. J. Health-Syst. Pharm.* 56 Suppl. 3: S16-S20.

The 13237, 18480, 2245, 16228, 7677, 26320, 46619, 33166, 16836, 46867, 21617, 55562, 39228, 62088, 46745, 23155, 21657, 42755, 32229, 22325, 46863 or 32252 molecules of the invention are also useful as pharmacogenomic markers. As used herein, a "pharmacogenomic marker" is an objective biochemical marker which correlates with a specific clinical drug response or susceptibility in a subject (see, e.g., McLeod et al. (1999) *Eur. J. Cancer* 35:1650-1652). The presence or quantity of the pharmacogenomic marker is related to the predicted response of the subject to a specific drug or class of drugs prior to administration of the drug. By assessing the presence or quantity of one or more pharmacogenomic markers in a subject, a drug therapy which is most appropriate for the subject, or which is predicted to have a greater degree of success, can be selected. For example, based on the presence or quantity of RNA, or protein (e.g., 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein or RNA) for specific tumor markers in a subject, a drug or course of treatment can be selected that is optimized for the treatment of the specific tumor likely to be present in the subject. Similarly, the presence or absence of a specific sequence mutation in 13237, 18480, 2245, 16228, 7677, 26320, 46619, 33166, 16836, 46867, 21617, 55562, 39228, 62088, 46745, 23155, 21657, 42755, 32229, 22325, 46863 or 32252 DNA can correlate with a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 drug response. The use of pharmacogenomic markers therefore permits the application of the most appropriate treatment for each subject without having to administer the therapy.

Pharmaceutical Compositions

The nucleic acid and polypeptides, fragments thereof, as well as anti-13237, 18480, 2245, 16228, 7677, 26320, 46619, 33166, 16836, 46867, 21617, 55562, 39228, 62088, 46745, 23155, 21657, 42755, 32229, 22325, 46863 or 32252 antibodies (also referred to herein as "active compounds") of the invention can be incorporated into pharmaceutical compositions. Such compositions typically include the nucleic acid molecule, protein, or antibody and a pharmaceutically acceptable carrier. As used herein the language "pharmaceutically acceptable carrier" includes solvents, dispersion media, coatings, antibacterial and antifungal agents, isotonic and absorption delaying agents, and the like, compatible with pharmaceutical administration. Supplementary active compounds can also be incorporated into the compositions.

A pharmaceutical composition is formulated to be compatible with its intended route of administration. Examples of routes of administration include parenteral, e.g., intravenous, intradermal, subcutaneous, oral (e.g., inhalation), transdermal (topical), transmucosal, and rectal administration. Solutions or suspensions used for parenteral, intradermal, or subcutaneous application can include the following components:

a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid; buffers such as acetates, citrates or phosphates and agents for the adjustment of tonicity such as sodium chloride or dextrose. pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL™ (BASF, Parsippany, N.J.) or phosphate buffered saline (PBS). In all cases, the composition must be sterile and should be fluid to the extent that easy syringability exists. It should be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyetheylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as manitol, sorbitol, sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound in the required amount in an appropriate solvent with one or a combination of ingredients enumerated above, as required, followed by filtered sterilization. Generally, dispersions are prepared by incorporating the active compound into a sterile vehicle which contains a basic dispersion medium and the required other ingredients from those enumerated above. In the case of sterile powders for the preparation of sterile injectable solutions, the preferred methods of preparation are vacuum drying and freeze-drying which yields a powder of the active ingredient plus any additional desired ingredient from a previously sterile-filtered solution thereof.

Oral compositions generally include an inert diluent or an edible carrier. For the purpose of oral therapeutic administration, the active compound can be incorporated with excipients and used in the form of tablets, troches, or capsules, e.g., gelatin capsules. Oral compositions can also be prepared using a fluid carrier for use as a mouthwash. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from pressured container or dispenser which contains a suitable propellant, e.g., a gas such as carbon dioxide, or a nebulizer.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The compounds can also be prepared in the form of suppositories (e.g., with conventional suppository bases such as cocoa butter and other glycerides) or retention enemas for rectal delivery.

In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. The materials can also be obtained commercially from Alza Corporation and Nova Pharmaceuticals, Inc. Liposomal suspensions (including liposomes targeted to infected cells with monoclonal antibodies to viral antigens) can also be used as pharmaceutically acceptable carriers. These can be prepared according to methods known to those skilled in the art, for example, as described in U.S. Pat. No. 4,522,811.

It is advantageous to formulate oral or parenteral compositions in dosage unit form for ease of administration and uniformity of dosage. Dosage unit form as used herein refers to physically discrete units suited as unitary dosages for the subject to be treated; each unit containing a predetermined quantity of active compound calculated to produce the desired therapeutic effect in association with the required pharmaceutical carrier.

Toxicity and therapeutic efficacy of such compounds can be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio $LD_{50}/ED_{50}$. Compounds which exhibit high therapeutic indices are preferred. While compounds that exhibit toxic side effects can be used, care should be taken to design a delivery system that targets such compounds to the site of affected tissue in order to minimize potential damage to uninfected cells and, thereby, reduce side effects.

The data obtained from the cell culture assays and animal studies can be used in formulating a range of dosage for use in humans. The dosage of such compounds lies preferably within a range of circulating concentrations that include the $ED_{50}$ with little or no toxicity. The dosage can vary within this range depending upon the dosage form employed and the route of administration utilized. For any compound used in the method of the invention, the therapeutically effective dose can be estimated initially from cell culture assays. A dose can be formulated in animal models to achieve a circulating plasma concentration range that includes the $IC_{50}$ (i.e., the concentration of the test compound which achieves a half-maximal inhibition of symptoms) as determined in cell culture. Such information can be used to more accurately determine useful doses in humans. Levels in plasma can be measured, for example, by high performance liquid chromatography.

As defined herein, a therapeutically effective amount of protein or polypeptide (i.e., an effective dosage) ranges from about 0.001 to 30 mg/kg body weight, preferably about 0.01 to 25 mg/kg body weight, more preferably about 0.1 to 20 mg/kg body weight, and even more preferably about 1 to 10 mg/kg, 2 to 9 mg/kg, 3 to 8 mg/kg, 4 to 7 mg/kg, or 5 to 6 mg/kg body weight. The protein or polypeptide can be administered one time per week for between about 1 to 10 weeks, preferably between 2 to 8 weeks, more preferably between about 3 to 7 weeks, and even more preferably for about 4, 5, or 6 weeks. The skilled artisan will appreciate that certain factors can influence the dosage and timing required to effectively treat a subject, including but not limited to the severity of the disease or disorder, previous treatments, the general health and/or age of the subject, and other diseases present. Moreover, treatment of a subject with a therapeutically effective amount of a protein, polypeptide, or antibody, unconjugated or conjugated as described herein, can include a single treatment or, preferably, can include a series of treatments.

For antibodies, the preferred dosage is 0.1 mg/kg of body weight (generally 10 mg/kg to 20 mg/kg). If the antibody is to act in the brain, a dosage of 50 mg/kg to 100 mg/kg is usually appropriate. Generally, partially human antibodies and fully human antibodies have a longer half-life within the human body than other antibodies. Accordingly, lower dosages and less frequent administration is often possible. Modifications such as lipidation can be used to stabilize antibodies and to enhance uptake and tissue penetration (e.g., into the brain). A method for lipidation of antibodies is described by Cruikshank et al. ((1997) *J. Acquired Immune Deficiency Syndromes and Human Retrovirology* 14:193).

The present invention encompasses agents which modulate expression or activity. An agent can, for example, be a small molecule. For example, such small molecules include, but are not limited to, peptides, peptidomimetics (e.g., peptoids), amino acids, amino acid analogs, polynucleotides, polynucleotide analogs, nucleotides, nucleotide analogs, organic or inorganic compounds (i.e., including heteroorganic and organometallic compounds) having a molecular weight less than about 10,000 grams per mole, organic or inorganic compounds having a molecular weight less than about 5,000 grams per mole, organic or inorganic compounds having a molecular weight less than about 1,000 grams per mole, organic or inorganic compounds having a molecular weight less than about 500 grams per mole, and salts, esters, and other pharmaceutically acceptable forms of such compounds.

Exemplary doses include milligram or microgram amounts of the small molecule per kilogram of subject or sample weight (e.g., about 1 microgram per kilogram to about 500 milligrams per kilogram, about 100 micrograms per kilogram to about 5 milligrams per kilogram, or about 1 microgram per kilogram to about 50 micrograms per kilogram. It is furthermore understood that appropriate doses of a small molecule depend upon the potency of the small molecule with respect to the expression or activity to be modulated. When one or more of these small molecules is to be administered to an animal (e.g., a human) in order to modulate expression or activity of a polypeptide or nucleic acid of the invention, a physician, veterinarian, or researcher can, for example, prescribe a relatively low dose at first, subsequently increasing the dose until an appropriate response is obtained. In addition, it is understood that the specific dose level for any particular animal subject will depend upon a variety of factors including the activity of the specific compound employed, the age, body weight, general health, gender, and diet of the subject, the time of administration, the route of administration, the rate of excretion, any drug combination, and the degree of expression or activity to be modulated.

The nucleic acid molecules of the invention can be inserted into vectors and used as gene therapy vectors. Gene therapy vectors can be delivered to a subject by, for example, intravenous injection, local administration (see U.S. Pat. No. 5,328,470) or by stereotactic injection (see e.g., Chen et al. (1994) *Proc. Natl. Acad. Sci. USA* 91:3054-3057). The pharmaceutical preparation of the gene therapy vector can include the gene therapy vector in an acceptable diluent, or can comprise a slow release matrix in which the gene delivery vehicle is imbedded. Alternatively, where the complete gene delivery vector can be produced intact from recombinant cells, e.g., retroviral vectors, the pharmaceutical preparation can include one or more cells which produce the gene delivery system.

The pharmaceutical compositions can be included in a container, pack, or dispenser together with instructions for administration.

Methods of Treatment:

The present invention provides for both prophylactic and therapeutic methods of treating a subject at risk of (or susceptible to) a disorder or having a disorder associated with aberrant or unwanted 13237, 18480, 2245, 16228, 7677, 26320, 46619, 33166, 16836, 46867, 21617, 55562, 39228, 62088, 46745, 23155, 21657, 42755, 32229, 22325, 46863 or 32252 expression or activity. As used herein, the term "treatment" is defined as the application or administration of a therapeutic agent to a patient, or application or administration of a therapeutic agent to an isolated tissue or cell line from a patient, who has a disease, a symptom of disease or a predisposition toward a disease, with the purpose to cure, heal, alleviate, relieve, alter, remedy, ameliorate, improve or affect the disease, the symptoms of disease or the predisposition toward disease. A therapeutic agent includes, but is not limited to, small molecules, peptides, antibodies, ribozymes and antisense oligonucleotides.

With regards to both prophylactic and therapeutic methods of treatment, such treatments can be specifically tailored or modified, based on knowledge obtained from the field of pharmacogenomics. "Pharmacogenomics", as used herein, refers to the application of genomics technologies such as gene sequencing, statistical genetics, and gene expression analysis to drugs in clinical development and on the market. More specifically, the term refers the study of how a patient's genes determine his or her response to a drug (e.g., a patient's "drug response phenotype", or "drug response genotype".) Thus, another aspect of the invention provides methods for tailoring an individual's prophylactic or therapeutic treatment with either the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 molecules of the present invention or 13237, 18480, 2245, 16228, 7677, 26320, 46619, 33166, 16836, 46867, 21617, 55562, 39228, 62088, 46745, 23155, 21657, 42755, 32229, 22325, 46863 or 32252 modulators according to that individual's drug response genotype. Pharmacogenomics allows a clinician or physician to target prophylactic or therapeutic treatments to patients who will most benefit from the treatment and to avoid treatment of patients who will experience toxic drug-related side effects.

In one aspect, the invention provides a method for preventing in a subject, a disease or condition associated with an aberrant or unwanted 13237, 18480, 2245, 16228, 7677, 26320, 46619, 33166, 16836, 46867, 21617, 55562, 39228, 62088, 46745, 23155, 21657, 42755, 32229, 22325, 46863 or 32252 expression or activity, by administering to the subject a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 or an agent which modulates 13237, 18480, 2245, 16228, 7677, 26320, 46619, 33166, 16836, 46867, 21617, 55562, 39228, 62088, 46745, 23155, 21657, 42755, 32229, 22325, 46863 or 32252 expression or at least one 13237, 18480, 2245, 16228, 7677, 26320, 46619, 33166, 16836, 46867, 21617, 55562, 39228, 62088, 46745, 23155, 21657, 42755, 32229, 22325, 46863 or 32252 activity. Subjects at risk for a disease which is caused or contributed to by aberrant or unwanted 13237, 18480, 2245, 16228, 7677, 26320, 46619, 33166, 16836, 46867, 21617, 55562, 39228, 62088, 46745, 23155, 21657, 42755, 32229, 22325, 46863 or 32252 expression or activity can be identified by, for example, any or a combination of diagnostic or prognostic assays as described herein. Administration of a prophylactic agent can occur prior to the manifestation of symptoms characteristic of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 aberrance, such that a disease or disorder is prevented or, alternatively, delayed in its progression. Depending on the type of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 aberrance, for example, a 13237, 18480, 2245, 16228, 7677, 26320, 46619, 33166, 16836, 46867, 21617, 55562, 39228, 62088, 46745, 23155, 21657, 42755, 32229, 22325, 46863 or 32252, 13237, 18480, 2245, 16228, 7677, 26320, 46619, 33166, 16836, 46867, 21617, 55562, 39228, 62088, 46745, 23155, 21657, 42755, 32229, 22325, 46863 or 32252 agonist or 13237, 18480, 2245, 16228, 7677, 26320, 46619, 33166, 16836, 46867, 21617, 55562, 39228, 62088, 46745, 23155, 21657, 42755, 32229, 22325, 46863 or 32252 antagonist agent can be used for treating the subject. The appropriate agent can be determined based on screening assays described herein.

It is possible that some 13237, 18480, 2245, 16228, 7677, 26320, 46619, 33166, 16836, 46867, 21617, 55562, 39228, 62088, 46745, 23155, 21657, 42755, 32229, 22325, 46863 or 32252 disorders can be caused, at least in part, by an abnormal level of gene product, or by the presence of a gene product exhibiting abnormal activity. As such, the reduction in the level and/or activity of such gene products would bring about the amelioration of disorder symptoms.

The 13237, 18480, 2245, 16228, 7677, 26320, 46619, 33166, 16836, 46867, 21617, 55562, 39228, 62088, 46745, 23155, 21657, 42755, 32229, 22325, 46863 or 32252 molecules can act as novel diagnostic targets and therapeutic agents for controlling one or more of a cellular proliferation and/or differentiation disorder, a cardiovascular, endothelial, breast, lung, colon, prostate, skin, pancreas, brain, blood vessel, platelet, bone, immune, metabolic, kidney, ovarian, viral, pain, liver, hematopoietic, skeletal muscle testicular, eye or hormonal disorder, all of which are described above.

As discussed, successful treatment of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 disorders can be brought about by techniques that serve to inhibit the expression or activity of target gene products. For example, compounds, e.g., an agent identified using an assays described above, that proves to exhibit negative modulatory activity, can be used in accordance with the invention to prevent and/or ameliorate symptoms of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 disorders. Such molecules can include, but are not limited to peptides, phosphopeptides, small organic or inorganic molecules, or antibodies (including, for example, polyclonal, monoclonal, humanized, human, anti-idiotypic, chimeric or single chain antibodies, and Fab, $F(ab')_2$ and Fab expression library fragments, scFV molecules, and epitope-binding fragments thereof).

Further, antisense and ribozyme molecules that inhibit expression of the target gene can also be used in accordance with the invention to reduce the level of target gene expression, thus effectively reducing the level of target gene activity. Still further, triple helix molecules can be utilized in reducing the level of target gene activity. Antisense, ribozyme and triple helix molecules are discussed above.

It is possible that the use of antisense, ribozyme, and/or triple helix molecules to reduce or inhibit mutant gene expression can also reduce or inhibit the transcription (triple helix) and/or translation (antisense, ribozyme) of mRNA produced by normal target gene alleles, such that the concentration of normal target gene product present can be lower than is necessary for a normal phenotype. In such cases, nucleic acid molecules that encode and express target gene polypeptides exhibiting normal target gene activity can be introduced into cells via gene therapy method. Alternatively, in instances in that the target gene encodes an extracellular protein, it can be preferable to co-administer normal target gene protein into the cell or tissue in order to maintain the requisite level of cellular or tissue target gene activity.

Another method by which nucleic acid molecules can be utilized in treating or preventing a disease characterized by 13237, 18480, 2245, 16228, 7677, 26320, 46619, 33166, 16836, 46867, 21617, 55562, 39228, 62088, 46745, 23155, 21657, 42755, 32229, 22325, 46863 or 32252 expression is through the use of aptamer molecules specific for 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein. Aptamers are nucleic acid molecules having a tertiary structure which permits them to specifically or selectively bind to protein ligands (see, e.g., Osborne et al. (1997) *Curr. Opin. Chem. Biol.* 1: 5-9; and Patel (1997) *Curr Opin Chem Biol* 1:32-46). Since nucleic acid molecules can in many cases be more conveniently introduced into target cells than therapeutic protein molecules can be, aptamers offer a method by which 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein activity can be specifically decreased without the introduction of drugs or other molecules which can have pluripotent effects.

Antibodies can be generated that are both specific for target gene product and that reduce target gene product activity. Such antibodies can, therefore, by administered in instances whereby negative modulatory techniques are appropriate for the treatment of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 disorders. For a description of antibodies, see the Antibody section above.

In circumstances wherein injection of an animal or a human subject with a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein or epitope for stimulating antibody production is harmful to the subject, it is possible to generate an immune response against 13237, 18480, 2245, 16228, 7677, 26320, 46619, 33166, 16836, 46867, 21617, 55562, 39228, 62088, 46745, 23155, 21657, 42755, 32229, 22325, 46863 or 32252 through the use of anti-idiotypic antibodies (see, for example, Herlyn (1999) *Ann Med* 31:66-78; and Bhattacharya-Chatterjee and Foon (1998) *Cancer Treat Res.* 94:51-68). If an anti-idiotypic antibody is introduced into a mammal or human subject, it should stimulate the production of anti-anti-idiotypic antibodies, which should be specific to the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein.

Vaccines directed to a disease characterized by 13237, 18480, 2245, 16228, 7677, 26320, 46619, 33166, 16836, 46867, 21617, 55562, 39228, 62088, 46745, 23155, 21657, 42755, 32229, 22325, 46863 or 32252 expression can also be generated in this fashion.

In instances where the target antigen is intracellular and whole antibodies are used, internalizing antibodies can be preferred. Lipofectin or liposomes can be used to deliver the antibody or a fragment of the Fab region that binds to the target antigen into cells. Where fragments of the antibody are used, the smallest inhibitory fragment that binds to the target antigen is preferred. For example, peptides having an amino acid sequence corresponding to the Fv region of the antibody can be used. Alternatively, single chain neutralizing antibodies that bind to intracellular target antigens can also be administered. Such single chain antibodies can be administered, for example, by expressing nucleotide sequences encoding single-chain antibodies within the target cell population (see e.g., Marasco et al. (1993) *Proc. Natl. Acad. Sci. USA* 90:7889-7893).

The identified compounds that inhibit target gene expression, synthesis and/or activity can be administered to a patient at therapeutically effective doses to prevent, treat or ameliorate 13237, 18480, 2245, 16228, 7677, 26320, 46619, 33166, 16836, 46867, 21617, 55562, 39228, 62088, 46745, 23155, 21657, 42755, 32229, 22325, 46863 or 32252 disorders. A therapeutically effective dose refers to that amount of the compound sufficient to result in amelioration of symptoms of the disorders. Toxicity and therapeutic efficacy of such compounds can be determined by standard pharmaceutical procedures as described above.

The data obtained from the cell culture assays and animal studies can be used in formulating a range of dosage for use in humans. The dosage of such compounds lies preferably within a range of circulating concentrations that include the $ED_{50}$ with little or no toxicity. The dosage can vary within this range depending upon the dosage form employed and the route of administration utilized. For any compound used in the method of the invention, the therapeutically effective dose can be estimated initially from cell culture assays. A dose can be formulated in animal models to achieve a circulating plasma concentration range that includes the $IC_{50}$ (i.e., the concentration of the test compound that achieves a half-maximal inhibition of symptoms) as determined in cell culture. Such information can be used to more accurately determine useful doses in humans. Levels in plasma can be measured, for example, by high performance liquid chromatography.

Another example of determination of effective dose for an individual is the ability to directly assay levels of "free" and "bound" compound in the serum of the test subject. Such assays can utilize antibody mimics and/or "biosensors" that have been created through molecular imprinting techniques. The compound which is able to modulate 13237, 18480, 2245, 16228, 7677, 26320, 46619, 33166, 16836, 46867, 21617, 55562, 39228, 62088, 46745, 23155, 21657, 42755, 32229, 22325, 46863 or 32252 activity is used as a template, or "imprinting molecule", to spatially organize polymerizable monomers prior to their polymerization with catalytic reagents. The subsequent removal of the imprinted molecule leaves a polymer matrix which contains a repeated "negative image" of the compound and is able to selectively rebind the molecule under biological assay conditions. A detailed review of this technique can be seen in Ansell et al (1996) *Current Opinion in Biotechnology* 7:89-94 and in Shea (1994) *Trends in Polymer Science* 2:166-173. Such "imprinted" affinity matrixes are amenable to ligand-binding assays, whereby the immobilized monoclonal antibody component is replaced by an appropriately imprinted matrix. An example of the use of such matrixes in this way can be seen in Vlatakis et al (1993) *Nature* 361:645-647. Through the use of isotope-labeling, the "free" concentration of compound which modulates the expression or activity of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 can be readily monitored and used in calculations of $IC_{50}$.

Such "imprinted" affinity matrixes can also be designed to include fluorescent groups whose photon-emitting properties measurably change upon local and selective binding of target compound. These changes can be readily assayed in real time using appropriate fiberoptic devices, in turn allowing the dose in a test subject to be quickly optimized based on its individual $IC_{50}$. An rudimentary example of such a "biosensor" is discussed in Kriz et al (1995) *Analytical Chemistry* 67:2142-2144.

Another aspect of the invention pertains to methods of modulating 13237, 18480, 2245, 16228, 7677, 26320, 46619, 33166, 16836, 46867, 21617, 55562, 39228, 62088, 46745, 23155, 21657, 42755, 32229, 22325, 46863 or 32252 expression or activity for therapeutic purposes. Accordingly, in an exemplary embodiment, the modulatory method of the invention involves contacting a cell with a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 or agent that modulates one or more of the activities of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein activity associated with the cell. An agent that modulates 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein activity can be an agent as described herein, such as a nucleic acid or a protein, a naturally-occurring target molecule of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein (e.g., a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 substrate or receptor), a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 antibody, a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 agonist or antagonist, a peptidomimetic of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 agonist or antagonist, or other small molecule.

In one embodiment, the agent stimulates one or 13237, 18480, 2245, 16228, 7677, 26320, 46619, 33166, 16836, 46867, 21617, 55562, 39228, 62088, 46745, 23155, 21657, 42755, 32229, 22325, 46863 or 32252 activities. Examples of such stimulatory agents include active 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein and a nucleic acid molecule encoding 13237, 18480, 2245, 16228, 7677, 26320, 46619, 33166, 16836, 46867, 21617, 55562, 39228, 62088, 46745, 23155, 21657, 42755, 32229, 22325, 46863 or 32252. In another embodiment, the agent inhibits one or more 13237, 18480, 2245, 16228, 7677, 26320, 46619, 33166, 16836, 46867, 21617, 55562, 39228, 62088, 46745, 23155, 21657, 42755, 32229, 22325, 46863 or 32252 activities. Examples of such inhibitory agents include antisense 13237, 18480, 2245, 16228, 7677, 26320, 46619, 33166, 16836, 46867, 21617, 55562, 39228, 62088, 46745, 23155, 21657, 42755, 32229, 22325, 46863 or 32252 nucleic acid molecules, anti-13237, 18480, 2245, 16228, 7677, 26320, 46619, 33166, 16836, 46867, 21617, 55562, 39228, 62088, 46745, 23155, 21657, 42755, 32229, 22325, 46863 or 32252 antibodies, and 13237, 18480, 2245, 16228, 7677, 26320, 46619, 33166, 16836, 46867, 21617, 55562, 39228, 62088, 46745, 23155, 21657, 42755, 32229, 22325, 46863 or 32252 inhibitors. These modulatory methods can be performed in vitro (e.g., by culturing the cell with the agent) or, alternatively, in vivo (e.g., by administering the agent to a subject). As such, the present invention provides methods of treating an individual afflicted with a disease or disorder characterized by aberrant or unwanted expression or activity of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein or nucleic acid molecule. In one embodiment, the method involves administering an agent (e.g., an agent identified by a screening assay described herein), or combination of agents that modulates (e.g., up regulates or down regulates) 13237, 18480, 2245, 16228, 7677, 26320, 46619, 33166, 16836, 46867, 21617, 55562, 39228, 62088, 46745, 23155, 21657, 42755, 32229, 22325, 46863 or 32252 expression or activity. In another embodiment, the method involves administering a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein or nucleic acid molecule as therapy to compensate for reduced, aberrant, or unwanted 13237, 18480, 2245, 16228, 7677, 26320, 46619, 33166, 16836, 46867, 21617, 55562, 39228, 62088, 46745, 23155, 21657, 42755, 32229, 22325, 46863 or 32252 expression or activity.

Stimulation of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 activity is desirable in situations in which 13237, 18480, 2245, 16228, 7677, 26320, 46619, 33166, 16836, 46867, 21617, 55562, 39228, 62088, 46745, 23155, 21657, 42755, 32229, 22325, 46863 or 32252 is abnormally downregulated and/or in which increased 13237, 18480, 2245, 16228, 7677, 26320, 46619, 33166, 16836, 46867, 21617, 55562, 39228, 62088, 46745, 23155, 21657, 42755, 32229, 22325, 46863 or 32252 activity is likely to have a beneficial effect. For example, stimulation of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 activity is desirable in situations in which a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 is downregulated and/or in which increased 13237, 18480, 2245, 16228, 7677, 26320, 46619, 33166, 16836, 46867, 21617, 55562, 39228, 62088, 46745, 23155, 21657, 42755, 32229, 22325, 46863 or 32252 activity is likely to have a beneficial effect. Likewise, inhibition of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 activity is desirable in situations in which 13237, 18480, 2245, 16228, 7677, 26320, 46619, 33166, 16836, 46867, 21617, 55562, 39228, 62088, 46745, 23155, 21657, 42755, 32229, 22325, 46863 or 32252 is abnormally upregulated and/or in which decreased 13237, 18480, 2245, 16228, 7677, 26320, 46619, 33166, 16836, 46867, 21617, 55562, 39228, 62088, 46745, 23155, 21657, 42755, 32229, 22325, 46863 or 32252 activity is likely to have a beneficial effect.

Pharmacogenomics

The 13237, 18480, 2245, 16228, 7677, 26320, 46619, 33166, 16836, 46867, 21617, 55562, 39228, 62088, 46745, 23155, 21657, 42755, 32229, 22325, 46863 or 32252 molecules of the present invention, as well as agents, or modulators which have a stimulatory or inhibitory effect on 13237, 18480, 2245, 16228, 7677, 26320, 46619, 33166, 16836, 46867, 21617, 55562, 39228, 62088, 46745, 23155, 21657, 42755, 32229, 22325, 46863 or 32252 activity (e.g., 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene expression) as identified by a screening assay described herein can be administered to individuals to treat (prophylactically or therapeutically) 13237, 18480, 2245, 16228, 7677, 26320, 46619, 33166, 16836, 46867, 21617, 55562, 39228, 62088, 46745, 23155, 21657, 42755, 32229, 22325, 46863 or 32252-associated disorders (e.g., aberrant or deficient protein kinase activity, methyltransferase activity, acyl-CoA dehydrogenase activity, short chain dehyrdogenase activity, reductase activity, acyltransferase activity, phosphatase activity, transferase activity, ATP-ase activity or synthase activity) associated with aberrant or unwanted 13237, 18480, 2245, 16228, 7677, 26320, 46619, 33166, 16836, 46867, 21617, 55562, 39228, 62088, 46745, 23155, 21657, 42755, 32229, 22325, 46863 or 32252 activity.

In conjunction with such treatment, pharmacogenomics (i.e., the study of the relationship between an individual's genotype and that individual's response to a foreign compound or drug) can be considered. Differences in metabolism of therapeutics can lead to severe toxicity or therapeutic failure by altering the relation between dose and blood concentration of the pharmacologically active drug. Thus, a physician or clinician can consider applying knowledge obtained in relevant pharmacogenomics studies in determining whether to administer a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 molecule or 13237, 18480, 2245, 16228, 7677, 26320, 46619, 33166, 16836, 46867, 21617, 55562, 39228, 62088, 46745, 23155, 21657, 42755, 32229, 22325, 46863 or 32252 modulator as well as tailoring the dosage and/or therapeutic regimen of treatment with a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 molecule or 13237, 18480, 2245, 16228, 7677, 26320, 46619, 33166, 16836, 46867, 21617, 55562, 39228, 62088, 46745, 23155, 21657, 42755, 32229, 22325, 46863 or 32252 modulator.

Pharmacogenomics deals with clinically significant hereditary variations in the response to drugs due to altered drug disposition and abnormal action in affected persons. See, for example, Eichelbaum et al. (1996) *Clin. Exp. Pharmacol. Physiol.* 23:983-985 and Linder et al. (1997) *Clin. Chem.* 43:254-266. In general, two types of pharmacogenetic conditions can be differentiated. Genetic conditions transmitted as a single factor altering the way drugs act on the body (altered drug action) or genetic conditions transmitted as single factors altering the way the body acts on drugs (altered drug metabolism). These pharmacogenetic conditions can occur either as rare genetic defects or as naturally-occurring polymorphisms. For example, glucose-6-phosphate dehydrogenase deficiency (G6PD) is a common inherited enzymopathy in which the main clinical complication is haemolysis after ingestion of oxidant drugs (anti-malarials, sulfonamides, analgesics, nitrofurans) and consumption of fava beans.

One pharmacogenomics approach to identifying genes that predict drug response, known as "a genome-wide association", relies primarily on a high-resolution map of the human genome consisting of already known gene-related markers (e.g., a "bi-allelic" gene marker map which consists of 60,000-100,000 polymorphic or variable sites on the human genome, each of which has two variants.) Such a high-resolution genetic map can be compared to a map of the genome of each of a statistically significant number of patients taking part in a Phase II/III drug trial to identify markers associated with a particular observed drug response or side effect. Alternatively, such a high resolution map can be generated from a combination of some ten-million known single nucleotide polymorphisms (SNPs) in the human genome. As used herein, a "SNP" is a common alteration that occurs in a single nucleotide base in a stretch of DNA. For example, a SNP can occur once per every 1000 bases of DNA. A SNP can be involved in a disease process, however, the vast majority can not be disease-associated. Given a genetic map based on the occurrence of such SNPs, individuals can be grouped into genetic categories depending on a particular pattern of SNPs in their individual genome. In such a manner, treatment regimens can be tailored to groups of genetically similar individuals, taking into account traits that can be common among such genetically similar individuals.

Alternatively, a method termed the "candidate gene approach", can be utilized to identify genes that predict drug response. According to this method, if a gene that encodes a drug's target is known (e.g., a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein of the present invention), all common variants of that gene can be fairly easily identified in the population and it can be determined if having one version of the gene versus another is associated with a particular drug response.

Alternatively, a method termed the "gene expression profiling", can be utilized to identify genes that predict drug response. For example, the gene expression of an animal dosed with a drug (e.g., a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 molecule or 13237, 18480, 2245, 16228, 7677, 26320, 46619, 33166, 16836, 46867, 21617, 55562, 39228, 62088, 46745, 23155, 21657, 42755, 32229, 22325, 46863 or 32252 modulator of the present invention) can give an indication whether gene pathways related to toxicity have been turned on.

Information generated from more than one of the above pharmacogenomics approaches can be used to determine appropriate dosage and treatment regimens for prophylactic or therapeutic treatment of an individual. This knowledge, when applied to dosing or drug selection, can avoid adverse reactions or therapeutic failure and thus enhance therapeutic or prophylactic efficiency when treating a subject with a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 molecule or 13237, 18480, 2245, 16228, 7677, 26320, 46619, 33166, 16836, 46867, 21617, 55562, 39228, 62088, 46745, 23155, 21657, 42755, 32229, 22325, 46863 or 32252 modulator, such as a modulator identified by one of the exemplary screening assays described herein.

The present invention further provides methods for identifying new agents, or combinations, that are based on identifying agents that modulate the activity of one or more of the gene products encoded by one or more of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 genes of the present invention, wherein these products can be associated with resistance of the cells to a therapeutic agent. Specifically, the activity of the proteins encoded by the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 genes of the present invention can be used as a basis for identifying agents for overcoming agent resistance. By blocking the activity of one or more of the resistance proteins, target cells, e.g., human cells, will become sensitive to treatment with an agent to which the unmodified target cells were resistant.

Monitoring the influence of agents (e.g., drugs) on the expression or activity of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein can be applied in clinical trials. For example, the effectiveness of an agent determined by a screening assay as described herein to increase 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene expression, protein levels, or upregulate 13237, 18480, 2245, 16228, 7677, 26320, 46619, 33166, 16836, 46867, 21617, 55562, 39228, 62088, 46745, 23155, 21657, 42755, 32229, 22325, 46863 or 32252 activity, can be monitored in clinical trials of subjects exhibiting decreased 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene expression, protein levels, or downregulated 13237, 18480, 2245, 16228, 7677, 26320, 46619, 33166, 16836, 46867, 21617, 55562, 39228, 62088, 46745, 23155, 21657, 42755, 32229, 22325, 46863 or 32252 activity. Alternatively, the effectiveness of an agent determined by a screening assay to decrease 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene expression, protein levels, or downregulate 13237, 18480, 2245, 16228, 7677, 26320, 46619, 33166, 16836, 46867, 21617, 55562, 39228, 62088, 46745, 23155, 21657, 42755, 32229, 22325, 46863 or 32252 activity, can be monitored in clinical trials of subjects exhibiting increased 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene expression, protein levels, or upregulated 13237, 18480, 2245, 16228, 7677, 26320, 46619, 33166, 16836, 46867, 21617, 55562, 39228, 62088, 46745, 23155, 21657, 42755, 32229, 22325, 46863 or 32252 activity. In such clinical trials, the expression or activity of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene, and preferably, other genes that have been implicated in, for example, a [FAMILYNAME]-associated or another 13237, 18480, 2245, 16228, 7677, 26320, 46619, 33166, 16836, 46867, 21617, 55562, 39228, 62088, 46745, 23155, 21657, 42755, 32229, 22325, 46863 or 32252-associated disorder can be used as a "read out" or markers of the phenotype of a particular cell.

Other Embodiments

In another aspect, the invention features a method of analyzing a plurality of capture probes. The method is useful, e.g., to analyze gene expression. The method includes: providing a two dimensional array having a plurality of addresses, each address of the plurality being positionally distinguishable from each other address of the plurality, and each address of the plurality having a unique capture probe, e.g., a nucleic acid or peptide sequence, wherein the capture probes are from a cell or subject which expresses 13237, 18480, 2245, 16228, 7677, 26320, 46619, 33166, 16836, 46867, 21617, 55562, 39228, 62088, 46745, 23155, 21657, 42755, 32229, 22325, 46863 or 32252 or from a cell or subject in which a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 mediated response has been elicited; contacting the array with a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 nucleic acid (preferably purified), a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptide (preferably purified), or an anti-13237, 18480, 2245, 16228, 7677, 26320, 46619, 33166, 16836, 46867, 21617, 55562, 39228, 62088, 46745, 23155, 21657, 42755, 32229, 22325, 46863 or 32252 antibody, and thereby evaluating the plurality of capture probes. Binding, e.g., in the case of a nucleic acid, hybridization with a capture probe at an address of the plurality, is detected, e.g., by a signal generated from a label attached to the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 nucleic acid, polypeptide, or antibody.

The capture probes can be a set of nucleic acids from a selected sample, e.g., a sample of nucleic acids derived from a control or non-stimulated tissue or cell.

The method can include contacting the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 nucleic acid, polypeptide, or antibody with a first array having a plurality of capture probes and a second array having a different plurality of capture probes. The results of each hybridization can be compared, e.g., to analyze differences in expression between a first and second sample. The first plurality of capture probes can be from a control sample, e.g., a wild type, normal, or non-diseased, non-stimulated, sample, e.g., a biological fluid, tissue, or cell sample. The second plurality of capture probes can be from an experimental sample, e.g., a mutant type, at risk, disease-state or disorder-state, or stimulated, sample, e.g., a biological fluid, tissue, or cell sample.

The plurality of capture probes can be a plurality of nucleic acid probes each of which specifically hybridizes, with an allele of 13237, 18480, 2245, 16228, 7677, 26320, 46619, 33166, 16836, 46867, 21617, 55562, 39228, 62088, 46745, 23155, 21657, 42755, 32229, 22325, 46863 or 32252. Such methods can be used to diagnose a subject, e.g., to evaluate risk for a disease or disorder, to evaluate suitability of a selected treatment for a subject, to evaluate whether a subject has a disease or disorder.

The method can be used to detect SNPs, as described above.

In another aspect, the invention features, a method of analyzing 13237, 18480, 2245, 16228, 7677, 26320, 46619, 33166, 16836, 46867, 21617, 55562, 39228, 62088, 46745, 23155, 21657, 42755, 32229, 22325, 46863 or 32252, e.g., analyzing structure, function, or relatedness to other nucleic acid or amino acid sequences. The method includes: providing a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 nucleic acid or amino acid sequence; comparing the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 sequence with one or more preferably a plurality of sequences from a collection of sequences, e.g., a nucleic acid or protein sequence database; to thereby analyze 13237, 18480, 2245, 16228, 7677, 26320, 46619, 33166, 16836, 46867, 21617, 55562, 39228, 62088, 46745, 23155, 21657, 42755, 32229, 22325, 46863 or 32252.

The method can include evaluating the sequence identity between a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 sequence and a database sequence. The method can be performed by accessing the database at a second site, e.g., over the internet. Preferred databases include GenBank™ and SwissProt.

In another aspect, the invention features, a set of oligonucleotides, useful, e.g., for identifying SNP's, or identifying specific alleles of 13237, 18480, 2245, 16228, 7677, 26320, 46619, 33166, 16836, 46867, 21617, 55562, 39228, 62088, 46745, 23155, 21657, 42755, 32229, 22325, 46863 or 32252. The set includes a plurality of oligonucleotides, each of which has a different nucleotide at an interrogation position, e.g., an SNP or the site of a mutation. In a preferred embodiment, the oligonucleotides of the plurality identical in sequence with one another (except for differences in length). The oligonucleotides can be provided with differential labels, such that an oligonucleotide which hybridizes to one allele provides a signal that is distinguishable from an oligonucleotides which hybridizes to a second allele.

The sequences of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 molecules are provided in a variety of mediums to facilitate use thereof. A sequence can be provided as a manufacture, other than an isolated nucleic acid or amino acid molecule, which contains a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 molecule. Such a manufacture can provide a nucleotide or amino acid sequence, e.g., an open reading frame, in a form which allows examination of the manufacture using means not directly applicable to examining the nucleotide or amino acid sequences, or a subset thereof, as they exist in nature or in purified form.

A 13237, 18480, 2245, 16228, 7677, 26320, 46619, 33166, 16836, 46867, 21617, 55562, 39228, 62088, 46745, 23155, 21657, 42755, 32229, 22325, 46863 or 32252 nucleotide or amino acid sequence can be recorded on computer readable media. As used herein, "computer readable media" refers to any medium that can be read and accessed directly by a computer. Such media include, but are not limited to: magnetic storage media, such as floppy discs, hard disc storage medium, and magnetic tape; optical storage media such as compact disc and CD-ROM; electrical storage media such as RAM, ROM, EPROM, EEPROM, and the like; and general hard disks and hybrids of these categories such as magnetic/optical storage media. The medium is adapted or configured for having thereon 13237, 18480, 2245, 16228, 7677, 26320, 46619, 33166, 16836, 46867, 21617, 55562, 39228, 62088, 46745, 23155, 21657, 42755, 32229, 22325, 46863 or 32252 sequence information of the present invention.

As used herein, the term "electronic apparatus" is intended to include any suitable computing or processing apparatus of other device configured or adapted for storing data or information. Examples of electronic apparatus suitable for use with the present invention include stand-alone computing apparatus; networks, including a local area network (LAN), a wide area network (WAN) Internet, Intranet, and Extranet; electronic appliances such as personal digital assistants (PDAs), cellular phones, pagers, and the like; and local and distributed processing systems.

As used herein, "recorded" refers to a process for storing or encoding information on the electronic apparatus readable medium. Those skilled in the art can readily adopt any of the presently known methods for recording information on known media to generate manufactures comprising the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 sequence information.

A variety of data storage structures are available to a skilled artisan for creating a computer readable medium having recorded thereon a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 nucleotide or amino acid sequence of the present invention. The choice of the data storage structure will generally be based on the means chosen to access the stored information. In addition, a variety of data processor programs and formats can be used to store the nucleotide sequence information of the present invention on computer readable medium. The sequence information can be represented in a word processing text file, formatted in commercially-available software such as WordPerfect and Microsoft Word, or represented in the form of an ASCII file, stored in a database application, such as DB2, Sybase, Oracle, or the like. The skilled artisan can readily adapt any number of data processor structuring formats (e.g., text file or database) in order to obtain computer readable medium having recorded thereon the nucleotide sequence information of the present invention.

By providing the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 nucleotide or amino acid sequences of the invention in computer readable form, the skilled artisan can routinely access the sequence information for a variety of purposes. For example, one skilled in the art can use the nucleotide or amino acid sequences of the invention in computer readable form to compare a target sequence or target structural motif with the sequence information stored within the data storage means. A search is used to identify fragments or regions of the sequences of the invention which match a particular target sequence or target motif.

The present invention therefore provides a medium for holding instructions for performing a method for determining whether a subject has a protein kinase, methyltransferase, acyl-CoA dehydrogenase, short chain dehyrdogenase, reductase, acyltransferase, phosphatase, transferase, ATP-ase or synthase-associated or another 13237, 18480, 2245, 16228, 7677, 26320, 46619, 33166, 16836, 46867, 21617, 55562, 39228, 62088, 46745, 23155, 21657, 42755, 32229, 22325, 46863 or 32252-associated disease or disorder or a pre-disposition to a protein kinase, methyltransferase, acyl-CoA dehydrogenase, short chain dehyrdogenase, reductase, acyltransferase, phosphatase, transferase, ATP-ase or synthase-associated or another 13237, 18480, 2245, 16228, 7677, 26320, 46619, 33166, 16836, 46867, 21617, 55562, 39228, 62088, 46745, 23155, 21657, 42755, 32229, 22325, 46863 or 32252-associated disease or disorder, wherein the method comprises the steps of determining 13237, 18480, 2245, 16228, 7677, 26320, 46619, 33166, 16836, 46867, 21617, 55562, 39228, 62088, 46745, 23155, 21657, 42755, 32229, 22325, 46863 or 32252 sequence information associated with the subject and based on the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 sequence information, determining whether the subject has a protein kinase, methyltransferase, acyl-CoA dehydrogenase, short chain dehyrdogenase, reductase, acyltransferase, phosphatase, transferase, ATP-ase or synthase-associated or another 13237, 18480, 2245, 16228, 7677, 26320, 46619, 33166, 16836, 46867, 21617, 55562, 39228, 62088, 46745, 23155, 21657, 42755, 32229, 22325, 46863 or 32252-associated disease or disorder and/or recommending a particular treatment for the disease, disorder, or pre-disease condition.

The present invention further provides in an electronic system and/or in a network, a method for determining whether a subject has a protein kinase, methyltransferase, acyl-CoA dehydrogenase, short chain dehyrdogenase, reductase, acyltransferase, phosphatase, transferase, ATP-ase or synthase-associated or another 13237, 18480, 2245, 16228, 7677, 26320, 46619, 33166, 16836, 46867, 21617, 55562, 39228, 62088, 46745, 23155, 21657, 42755, 32229, 22325, 46863 or 32252-associated disease or disorder or a pre-disposition to a disease associated with 13237, 18480, 2245, 16228, 7677, 26320, 46619, 33166, 16836, 46867, 21617, 55562, 39228, 62088, 46745, 23155, 21657, 42755, 32229, 22325, 46863 or 32252, wherein the method comprises the steps of determining 13237, 18480, 2245, 16228, 7677, 26320, 46619, 33166, 16836, 46867, 21617, 55562, 39228, 62088, 46745, 23155, 21657, 42755, 32229, 22325, 46863 or 32252 sequence information associated with the subject, and based on the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 sequence information, determining whether the subject has a protein kinase, methyltransferase, acyl-CoA dehydrogenase, short chain dehyrdogenase, reductase, acyltransferase, phosphatase, transferase, ATP-ase or synthase-associated or another 13237, 18480, 2245, 16228, 7677, 26320, 46619, 33166, 16836, 46867, 21617, 55562, 39228, 62088, 46745, 23155, 21657, 42755, 32229, 22325, 46863 or 32252-associated disease or disorder or a pre-disposition to a protein kinase, methyltransferase, acyl-CoA dehydrogenase, short chain dehyrdogenase, reductase, acyltransferase, phosphatase, transferase, ATP-ase or synthase-associated or another 13237, 18480, 2245, 16228, 7677, 26320, 46619, 33166, 16836, 46867, 21617, 55562, 39228, 62088, 46745, 23155, 21657, 42755, 32229, 22325, 46863 or 32252-associated disease or disorder, and/or recommending a particular treatment for the disease, disorder, or pre-disease condition. The method may further comprise the step of receiving phenotypic information associated with the subject and/or acquiring from a network phenotypic information associated with the subject.

The present invention also provides in a network, a method for determining whether a subject has a protein kinase, methyltransferase, acyl-CoA dehydrogenase, short chain dehyrdogenase, reductase, acyltransferase, phosphatase, transferase, ATP-ase or synthase-associated or another 13237, 18480, 2245, 16228, 7677, 26320, 46619, 33166, 16836, 46867, 21617, 55562, 39228, 62088, 46745, 23155, 21657, 42755, 32229, 22325, 46863 or 32252-associated disease or disorder or a pre-disposition to a protein kinase, methyltransferase, acyl-CoA dehydrogenase, short chain dehyrdogenase, reductase, acyltransferase, phosphatase, transferase, ATP-ase or synthase-associated or another 13237, 18480, 2245, 16228, 7677, 26320, 46619, 33166, 16836, 46867, 21617, 55562, 39228, 62088, 46745, 23155, 21657, 42755, 32229, 22325, 46863 or 32252-associated disease or disorder, said method comprising the steps of receiving 13237, 18480, 2245, 16228, 7677, 26320, 46619, 33166, 16836, 46867, 21617, 55562, 39228, 62088, 46745, 23155, 21657, 42755, 32229, 22325, 46863 or 32252 sequence information from the subject and/or information related thereto, receiving phenotypic information associated with the subject, acquiring information from the network corresponding to 13237, 18480, 2245, 16228, 7677, 26320, 46619, 33166, 16836, 46867, 21617, 55562, 39228, 62088, 46745, 23155, 21657, 42755, 32229, 22325, 46863 or 32252 and/or corresponding to a protein kinase, methyltransferase, acyl-CoA dehydrogenase, short chain dehyrdogenase, reductase, acyltransferase, phosphatase, transferase, ATP-ase or synthase-associated or another 13237, 18480, 2245, 16228, 7677, 26320, 46619, 33166, 16836, 46867, 21617, 55562, 39228, 62088, 46745, 23155, 21657, 42755, 32229, 22325, 46863 or 32252-associated disease or disorder, and based on one or more of the phenotypic information, the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 information (e.g., sequence information and/or information related thereto), and the acquired information, determining whether the subject has a protein kinase, methyltransferase, acyl-CoA dehydrogenase, short chain dehyrdogenase, reductase, acyltransferase, phosphatase, transferase, ATP-ase or synthase-associated or another 13237, 18480, 2245, 16228, 7677, 26320, 46619, 33166, 16836, 46867, 21617, 55562, 39228, 62088, 46745, 23155, 21657, 42755, 32229, 22325, 46863 or 32252-associated disease or disorder or a pre-disposition to a protein kinase, methyltransferase, acyl-CoA dehydrogenase, short chain dehyrdogenase, reductase, acyltransferase, phosphatase, transferase, ATP-ase or synthase-associated or another 13237, 18480, 2245, 16228, 7677, 26320, 46619, 33166, 16836, 46867, 21617, 55562, 39228, 62088, 46745, 23155, 21657, 42755, 32229, 22325, 46863 or 32252-associated disease or disorder. The method may further comprise the step of recommending a particular treatment for the disease, disorder, or pre-disease condition.

The present invention also provides a business method for determining whether a subject has a protein kinase, methyltransferase, acyl-CoA dehydrogenase, short chain dehyrdogenase, reductase, acyltransferase, phosphatase, transferase, ATP-ase or synthase-associated or another 13237, 18480, 2245, 16228, 7677, 26320, 46619, 33166, 16836, 46867, 21617, 55562, 39228, 62088, 46745, 23155, 21657, 42755, 32229, 22325, 46863 or 32252-associated disease or disorder or a pre-disposition to a protein kinase, methyltransferase, acyl-CoA dehydrogenase, short chain dehyrdogenase, reductase, acyltransferase, phosphatase, transferase, ATP-ase or synthase-associated or another 13237, 18480, 2245, 16228, 7677, 26320, 46619, 33166, 16836, 46867, 21617, 55562, 39228, 62088, 46745, 23155, 21657, 42755, 32229, 22325, 46863 or 32252-associated disease or disorder, said method comprising the steps of receiving information related to 13237, 18480, 2245, 16228, 7677, 26320, 46619, 33166, 16836, 46867, 21617, 55562, 39228, 62088, 46745, 23155, 21657, 42755, 32229, 22325, 46863 or 32252 (e.g., sequence information and/or information related thereto), receiving phenotypic information associated with the subject, acquiring information from the network related to 13237, 18480, 2245, 16228, 7677, 26320, 46619, 33166, 16836, 46867, 21617, 55562, 39228, 62088, 46745, 23155, 21657, 42755, 32229, 22325, 46863 or 32252 and/or related to a protein kinase, methyltransferase, acyl-CoA dehydrogenase, short chain dehydrogenase, reductase, acyltransferase, phosphatase, transferase, ATP-ase or synthase-associated or another 13237, 18480, 2245, 16228, 7677, 26320, 46619, 33166, 16836, 46867, 21617, 55562, 39228, 62088, 46745, 23155, 21657, 42755, 32229, 22325, 46863 or 32252-associated disease or disorder, and based on one or more of the phenotypic information, the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 information, and the acquired information, determining whether the subject has a protein kinase, methyltransferase, acyl-CoA dehydrogenase, short chain dehyrdogenase, reductase, acyltransferase, phosphatase, transferase, ATP-ase or synthase-associated or another 13237, 18480, 2245, 16228, 7677, 26320, 46619, 33166, 16836, 46867, 21617, 55562, 39228, 62088, 46745, 23155, 21657, 42755, 32229, 22325, 46863 or 32252-associated disease or disorder or a pre-disposition to a protein kinase, methyltransferase, acyl-CoA dehydrogenase, short chain dehyrdogenase, reductase, acyltransferase, phosphatase, transferase, ATP-ase or synthase-associated or another 13237, 18480, 2245, 16228, 7677, 26320, 46619, 33166, 16836, 46867, 21617, 55562, 39228, 62088, 46745, 23155, 21657, 42755, 32229, 22325, 46863 or 32252-associated disease or disorder. The method may further comprise the step of recommending a particular treatment for the disease, disorder, or pre-disease condition.

The invention also includes an array comprising a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 sequence of the present invention. The array can be used to assay expression of one or more genes in the array. In one embodiment, the array can be used to assay gene expression in a tissue to ascertain tissue specificity of genes in the array. In this manner, up to about 7600 genes can be simultaneously assayed for expression, one of which can be 13237, 18480, 2245, 16228, 7677, 26320, 46619, 33166, 16836, 46867, 21617, 55562, 39228, 62088, 46745, 23155, 21657, 42755, 32229, 22325, 46863 or 32252. This allows a profile to be developed showing a battery of genes specifically expressed in one or more tissues.

In addition to such qualitative information, the invention allows the quantitation of gene expression. Thus, not only tissue specificity, but also the level of expression of a battery of genes in the tissue if ascertainable. Thus, genes can be grouped on the basis of their tissue expression per se and level of expression in that tissue. This is useful, for example, in ascertaining the relationship of gene expression in that tissue. Thus, one tissue can be perturbed and the effect on gene expression in a second tissue can be determined. In this context, the effect of one cell type on another cell type in response to a biological stimulus can be determined. In this context, the effect of one cell type on another cell type in response to a biological stimulus can be determined. Such a determination is useful, for example, to know the effect of cell-cell interaction at the level of gene expression. If an agent is administered therapeutically to treat one cell type but has an undesirable effect on another cell type, the invention provides an assay to determine the molecular basis of the undesirable effect and thus provides the opportunity to co-administer a counteracting agent or otherwise treat the undesired effect. Similarly, even within a single cell type, undesirable biological effects can be determined at the molecular level. Thus, the effects of an agent on expression of other than the target gene can be ascertained and counteracted.

In another embodiment, the array can be used to monitor the time course of expression of one or more genes in the array. This can occur in various biological contexts, as disclosed herein, for example development of a protein kinase, methyltransferase, acyl-CoA dehydrogenase, short chain dehyrdogenase, reductase, acyltransferase, phosphatase, transferase, ATP-ase or synthase-associated or another 13237, 18480, 2245, 16228, 7677, 26320, 46619, 33166, 16836, 46867, 21617, 55562, 39228, 62088, 46745, 23155, 21657, 42755, 32229, 22325, 46863 or 32252-associated disease or disorder, progression of protein kinase, methyltransferase, acyl-CoA dehydrogenase, short chain dehyrdogenase, reductase, acyltransferase, phosphatase, transferase, ATP-ase or synthase-associated or another 13237, 18480, 2245, 16228, 7677, 26320, 46619, 33166, 16836, 46867, 21617, 55562, 39228, 62088, 46745, 23155, 21657, 42755, 32229, 22325, 46863 or 32252-associated disease or disorder, and processes, such a cellular transformation associated with the protein kinase, methyltransferase, acyl-CoA dehydrogenase, short chain dehyrdogenase, reductase, acyltransferase, phosphatase, transferase, ATP-ase or synthase-associated or another 13237, 18480, 2245, 16228, 7677, 26320, 46619, 33166, 16836, 46867, 21617, 55562, 39228, 62088, 46745, 23155, 21657, 42755, 32229, 22325, 46863 or 32252-associated disease or disorder.

The array is also useful for ascertaining the effect of the expression of a gene on the expression of other genes in the same cell or in different cells (e.g., ascertaining the effect of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 expression on the expression of other genes). This provides, for example, for a selection of alternate molecular targets for therapeutic intervention if the ultimate or downstream target cannot be regulated.

The array is also useful for ascertaining differential expression patterns of one or more genes in normal and abnormal cells. This provides a battery of genes (e.g., including 13237, 18480, 2245, 16228, 7677, 26320, 46619, 33166, 16836, 46867, 21617, 55562, 39228, 62088, 46745, 23155, 21657, 42755, 32229, 22325, 46863 or 32252) that could serve as a molecular target for diagnosis or therapeutic intervention.

As used herein, a "target sequence" can be any DNA or amino acid sequence of six or more nucleotides or two or more amino acids. A skilled artisan can readily recognize that the longer a target sequence is, the less likely a target sequence will be present as a random occurrence in the database. Typical sequence lengths of a target sequence are from about 10 to 100 amino acids or from about 30 to 300 nucleotide residues. However, it is well recognized that commercially important fragments, such as sequence fragments involved in gene expression and protein processing, may be of shorter length.

Computer software is publicly available which allows a skilled artisan to access sequence information provided in a computer readable medium for analysis and comparison to other sequences. A variety of known algorithms are disclosed publicly and a variety of commercially available software for conducting search means are and can be used in the computer-based systems of the present invention. Examples of such software include, but are not limited to, MacPattern (EMBL), BLASTN and BLASTX (NCBI).

Thus, the invention features a method of making a computer readable record of a sequence of a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 sequence which includes recording the sequence on a computer readable matrix. In a preferred embodiment the record includes one or more of the following: identification of an ORF; identification of a domain, region, or site; identification of the start of transcription; identification of the transcription terminator; the full length amino acid sequence of the protein, or a mature form thereof; the 5' end of the translated region.

In another aspect, the invention features a method of analyzing a sequence. The method includes: providing a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 sequence, or record, in computer readable form; comparing a second sequence to the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 sequence; thereby analyzing a sequence. Comparison can include comparing to sequences for sequence identity or determining if one sequence is included within the other, e.g., determining if the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 sequence includes a sequence being compared. In a preferred embodiment the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 or second sequence is stored on a first computer, e.g., at a first site and the comparison is performed, read, or recorded on a second computer, e.g., at a second site. E.g., the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 or second sequence can be stored in a public or proprietary database in one computer, and the results of the comparison performed, read, or recorded on a second computer. In a preferred embodiment the record includes one or more of the following: identification of an ORF; identification of a domain, region, or site; identification of the start of transcription; identification of the transcription terminator; the full length amino acid sequence of the protein, or a mature form thereof; the 5' end of the translated region.

EXEMPLIFICATION

Example 1

Tissue Distribution of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 mRNA Northern blot hybridizations with various RNA samples can be performed under standard conditions and washed under stringent conditions, i.e., 0.2×SSC at 65° C. A DNA probe corresponding to all or a portion of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 cDNA (SEQ ID NO:1, 3, 4, 6, 7, 9, 10, 12, 39, 41, 54, 56, 58, 59, 61, 63, 65, 66, 68, 75, 77, 79, 81, 82, 84, 89, 91, 92, 94, 95, 97, 107, 109, 112, 114, 117, 119, 120, 122, 127, 129, 139, 141, 151 or 153) or 13237, 18480, 2245, 16228, 7677, 26320, 46619, 33166, 16836, 46867, 21617, 55562, 39228, 62088, 46745, 23155, 21657, 42755, 32229, 22325, 46863 or 32252 cDNA can be used. The DNA was radioactively labeled with $^{32}$P-dCTP using the Prime-It Kit (Stratagene, La Jolla, Calif.) according to the instructions of the supplier. Filters containing mRNA from mouse hematopoietic and endocrine tissues, and cancer cell lines (Clontech, Palo Alto, Calif.) can be probed in ExpressHyb hybridization solution (Clontech) and washed at high stringency according to manufacturer's recommendations.

Example 2

Recombinant Expression of 13237, 18480, 2245, 16228, 7677, 26320, 46619, 33166, 16836, 46867, 21617, 55562, 39228, 62088, 46745, 23155, 21657, 42755, 32229, 22325, 46863 or 32252 in Bacterial Cells In this example, 13237, 18480, 2245, 16228, 7677, 26320, 46619, 33166, 16836, 46867, 21617, 55562, 39228, 62088, 46745, 23155, 21657, 42755, 32229, 22325, 46863 or 32252 is expressed as a recombinant glutathione-S-transferase (GST) fusion polypeptide in E. coli and the fusion polypeptide is isolated and characterized. Specifically, 13237, 18480, 2245, 16228, 7677, 26320, 46619, 33166, 16836, 46867, 21617, 55562, 39228, 62088, 46745, 23155, 21657, 42755, 32229, 22325, 46863 or 32252 is fused to GST and this fusion polypeptide is expressed in E. coli, e.g., strain PEB199. Expression of the GST-13237, -18480, -2245, -16228, -7677, -26320, -46619, -33166, -16836, -46867, -55562, -21617, -39228, -62088, -46745, -23155, -21657, -42755, -32229, -22325, -46863 or -32252 fusion protein in PEB199 is induced with IPTG. The recombinant fusion polypeptide is purified from crude bacterial lysates of the induced PEB199 strain by affinity chromatography on glutathione beads. Using polyacrylamide gel electrophoretic analysis of the polypeptide purified from the bacterial lysates, the molecular weight of the resultant fusion polypeptide is determined.

Example 3

Expression of Recombinant 13237, 18480, 2245, 16228, 7677, 26320, 46619, 33166, 16836, 46867, 21617, 55562, 39228, 62088, 46745, 23155, 21657, 42755, 32229, 22325, 46863 or 32252 Protein in COS Cells To express the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene in COS cells, the pcDNA/Amp vector by Invitrogen Corporation (San Diego, Calif.) is used. This vector contains an SV40 origin of replication, an ampicillin resistance gene, an E. coli replication origin, a CMV promoter followed by a polylinker region, and an SV40 intron and polyadenylation site. A DNA fragment encoding the entire 13237, 18480, 2245, 16228, 7677, 26320, 46619, 33166, 16836, 46867, 21617, 55562, 39228, 62088, 46745, 23155, 21657, 42755, 32229, 22325, 46863 or 32252 protein and an HA tag (Wilson et al. (1984) Cell 37:767) or a FLAG tag fused in-frame to its 3' end of the fragment is cloned into the polylinker region of the vector, thereby placing the expression of the recombinant protein under the control of the CMV promoter.

To construct the plasmid, the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 DNA sequence is amplified by PCR using two primers. The 5' primer contains the restriction site of interest followed by approximately twenty nucleotides of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 coding sequence starting from the initiation codon; the 3' end sequence contains complementary sequences to the other restriction site of interest, a translation stop codon, the HA tag or FLAG tag and the last 20 nucleotides of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 coding sequence. The PCR amplified fragment and the pcDNA/Amp vector are digested with the appropriate restriction enzymes and the vector is dephosphorylated using the CIAP enzyme (New England Biolabs, Beverly, Mass.). Preferably the two restriction sites chosen are different so that the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 gene is inserted in the correct orientation. The ligation mixture is transformed into E. coli cells (strains HB101, DH5α, SURE, available from Stratagene Cloning Systems, La Jolla, Calif., can be used), the transformed culture is plated on ampicillin media plates, and resistant colonies are selected. Plasmid DNA is isolated from transformants and examined by restriction analysis for the presence of the correct fragment.

COS cells are subsequently transfected with the 13237-, 18480-, 2245-, 16228-, 7677-, 26320-, 46619-, 33166-, 16836-, 46867-, 55562-, 21617-, 39228-, 62088-, 46745-, 23155-, 21657-, 42755-, 32229-, 22325-, 46863- or 32252-pcDNA/Amp plasmid DNA using the calcium phosphate or calcium chloride co-precipitation methods, DEAE-dextran-mediated transfection, lipofection, or electroporation. Other suitable methods for transfecting host cells can be found in Sambrook, J., Fritsh, E. F., and Maniatis, T. *Molecular Cloning: A Laboratory Manual.* 2nd, ed., Cold Spring Harbor Laboratory, Cold Spring Harbor Laboratory Press, Cold Spring Harbor, N.Y., 1989. The expression of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptide is detected by radiolabelling ($^{35}$S-methionine or $^{35}$S-cysteine available from NEN, Boston, Mass., can be used) and immunoprecipitation (Harlow, E. and Lane, D. *Antibodies: A Laboratory Manual*, Cold Spring Harbor Laboratory Press, Cold Spring Harbor, N.Y., 1988) using an HA specific monoclonal antibody. Briefly, the cells are labeled for 8 hours with $^{35}$S-methionine (or $^{35}$S-cysteine). The culture media are then collected and the cells are lysed using detergents (RIPA buffer, 150 mM NaCl, 1% NP-40, 0.1% SDS, 0.5% DOC, 50 mM Tris, pH 7.5). Both the cell lysate and the culture media are precipitated with an HA specific monoclonal antibody. Precipitated polypeptides are then analyzed by SDS-PAGE.

Alternatively, DNA containing the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 coding sequence is cloned directly into the polylinker of the pcDNA/Amp vector using the appropriate restriction sites. The resulting plasmid is transfected into COS cells in the manner described above, and the expression of the 13237, 18480, 2245, 16228, 7677, 26320, 46619, 33166, 16836, 46867, 21617, 55562, 39228, 62088, 46745, 23155, 21657, 42755, 32229, 22325, 46863 or 32252 polypeptide is detected by radiolabelling and immunoprecipitation using a 13237, 18480, 2245, 16228, 7677, 26320, 46619, 33166, 16836, 46867, 21617, 55562, 39228, 62088, 46745, 23155, 21657, 42755, 32229, 22325, 46863 or 32252 specific monoclonal antibody.

The contents of all references, patents and published patent applications cited throughout this application are incorporated herein by reference.

EQUIVALENTS

Those skilled in the art will recognize, or be able to ascertain using no more than routine experimentation, many equivalents to the specific embodiments of the invention described herein.

SEQUENCE LISTING (156 sequences)

SEQ ID NO: 1 - DNA, 3637 bp, Homo Sapiens
  CDS (77)...(3277)
  misc_feature (1)...(3637): n = A,T,C or G
gaacctggaccgcggcggcgccgggtttccctcatgatcccgggcgggcggcggcggcggcagaggcggcgggaggatgacctcttaccgggagcggagtgccgacctggcccgtttctacactgtcaccgagccccagcgacacccgaggggctacacagtatataaggtcaccgcccgggttgtttcacgaagaaatccagaggatgtccaggagataattgtatggaagagatacagtgattttaagaaactacacaaagaactatggcaaattcacaaaaacttattccgacattcagagttgtttcctccatttgctaaaggaatagtgtttgggcgatttgatgaaactgttatcgaagagagaagacaatgtgctgaagacctgctacagttctctgccaatattcctgctctttacaatagtaaacagcttgaagactttttcaagggtggaataattaatgatagttctgaattaattggtcctgctgaagctcactcagattccctcattgatacctttcctgagtgtagtacggaaggcttctccagtgacagtgatctggtatctcttactgttgatgtggattctcttgctgagttagatgatggaatggcttccaatcaaaattctcccattagaacttttggtctcaatctttcttcggattcttcagcactaggggctgttgcttctgacagtgaacagagcaaaacagaagaagaacgggaaagtcgtagcctctttcctggcagtttaaagccgaagcttggcaagagagattatttggagaaagcaggagaattaataaagctggctttaaaaaaggaagaagaagacgactatgaagctgcttctgatttttataggaagggagttgatttactcctagaaggtgttcaaggagagtcaagccctacccgtcgagaagctgtgaagagaagaacagccgagtacctcatgcgggcagaaagtatctctagtctttatgggaaacctcagcttgatgatgaatctcagcctccaggatcactaagttcaaggcccctttggaacctaaggagccctgccgaggagctgaaggccttcagagtccttggggtgattgacaaggttttacttgtaatggacacaaggacagaacagactttcattttaaaaggtctaaggaaaagcagtgaatacagcaggaacagaaagaccatcatcccccgctgtgtgcccaacatggtgtgtctgcataagtacatcatctctgaggagtcagtatttcttgtgctgcagcatgcggaaggtggcaaactgtggtcatatatcagtaaatttctaaacagaagtcctgaagaaagctttgacatcaaggaagtgaaaaaacctacacttgcaaaagttcacctgcagcagccaacttctagtcctcaggacagcagtagctttgaatccagaggaagtgatggtggaagcatgcttaaagctctgcctttgaagagtagtcttactccaagttctcaagatgacagcaaccaggaagatgatggccaagatagctctccaaagtggccagattctggttcaagttcagaagaagaatgtactactagttatttaacattatgcaatgaatatgggcaagaaaagattgaaccagggtctttgaatgaggagcccttcatgaagactgaagggaatggtgttgatacaaaagctattaaaagcttcccagcacaccttgctgctgacagtgacagccccagcacacagctgagagctcacgagctgaagttcttccccaacgatgacccagaagcagttagttctccaagaacatcagattccctcagtagatcaaaaaatagccccatggaattctttaggatagacagtaaggatagcgcaagtgaactcctgggacttgactttggagaaaaattgtatagtctaaaatcagaacctttgaaaccattctttactcttccagatggagacagtgcttctaggagttttaatactagtgaaagcaaggtagagtttaaagctcaggacaccattagcaggggctcagatgactcagtgccagttatttcatttaaagatgctgcttttgatgatgtcagtggtactgatgaaggaagacctgatcttcttgtaaatttacctggtgaattggagtcaacaagagaagctgcagcattgggacctactaagtttacacaaactaatatagggataatagaaaataaactcttggaagcccctgatgttttatgcctcaggcttagtactgaacaatgccaagcacatgaggagaaaggcatagaggaactgagtgatccctctgggcccaaatcctatagtataacagagaaacactatgcacaggaggatcccaggatgttatttgtagcagctgttgatcatagtagttcaggagatatgtctttgttacccagctcagatcctaagtttcaaggacttggagtggttgagtcagcagtaactgcaaacaacacagaagaaagcttattccgtatttgtagtccactctcaggtgctaatgaatatattgcaagcacagacactttaaaaacagaagaagtattgctgtttacagatcagactgatgatttggctaaagaggaaccaacttctttattccagagagactctgagactaagggtgaaagtggtttagtgctagaaggagacaaggaaatacatcagatttttgaggaccttgataaaaaattagcactagcctccaggttttacatcccagagggctgcattcaaagatgggcagctgaaatggtggtagcccttgatgctttacatagagagggaattgtgtgccgcgatttgaacccaaacaacatcttattgaatgatagaggacacattcagctaacgtattttagcaggtggagtgaggttgaagattcctgtgacagcgatgccatagagagaatgtactgtgccccagaggttggagcaatcactgaagaaactgaagcctgtgattggtggagtttgggtgctgtcctctttgaacttctcactggcaagactctggttgaatgccatccagcaggaataaatactcacactactttgaacatgccagaatgtgtctctgaagaggctcgctcactcattcaacagctcttgcagttcaatcctctggaacgacttggtgctggagttgctggtgttgaagatatcaaatctcatccattttttacccctgtggattgggcagaactgatgagatgaacgtaatgcagggttatcttcacacattctgatcttctctgtgacaggcatctccagcactgaggcacctctgactcacagttacttatggagcaccaaagcatttggataaagaccgttataggaaatgggggggaaatggctaaaagagaacaattcgtttacaattacaagatattagctaattgtgccaggggctgttatatacatatatacacaaccaaggtgtgatctgaatttaatccacatttggtgttgcagatgagttgtaaagccaactgaaagagttccttcaagaagttnctctgataggaagctagaagtgtagaatgaagttttacttgacagaaggacctttac

SEQ ID NO: 2 - protein, 1066 aa, Homo Sapiens
MTSYRERSADLARFYTVTEPQRHPRGYTVYKVTARVVSRRNPEDVQEIIVWKRYSDFKKLHKELWQIHKNLFRHSELFPPFAKGIVFGRFDETVIEERRQCAEDLLQFSANIPALYNSKQLEDFFKGGIINDSSELIGPAEAHSDSLIDTFPECSTEGFSSDSDLVSLTVDVDSLAELDDGMASNQNSPIRTFGLNLSSDSSALGAVASDSEQSKTEEERESRSLFPGSLKPKLGKRDYLEKAGELIKLALKKEEEDDYEAASDFYRKGVDLLLEGVQGESSPTRREAVKRRTAEYLMRAESISSLYGKPQLDDESQPPGSLSSRPLWNLRSPAEELKAFRVLGVIDKVLLVMDTRTEQTFILKGLRKSSEYSRNRKTIIPRCVPNMVCLHKYIISEESVFLVLQHAEGGKLWSYISKFLNRSPEESFDIKEVKKPTLAKVHLQQPTSSPQDSSSFESRGSDGGSMLKALPLKSSLTPSSQDDSNQEDDGQDSSPKWPDSGSSSEEECTTSYLTLCNEYGQEKIEPGSLNEEPFMKTEGNGVDTKAIKSFPAHLAADSDSPSTQLRAHELKFFPNDDPEAVSSPRTSDSLSRSKNSPMEFFRIDSKDSASELLGLDFGEKLYSLKSEPLKPFFTLPDGDSASRSFNTSESKVEFKAQDTISRGSDDSVPVISFKDAAFDDVSGTDEGRPDLLVNLPGELESTREAAALGPTKFTQTNIGIIENKLLEAPDVLCLRLSTEQCQAHEEKGIEELSDPSGPKSYSITEKHYAQEDPRMLFVAAVDHSSSGDMSLLPSSDPKFQGLGVVESAVTANNTEESLFRICSPLSGANEYIASTDTLKTEEVLLFTDQTDDLAKEEPTSLFQRDSETKGESGLVLEGDKEIHQIFEDLDKKLALASRFYIPEGCIQRWAAEMVVALDALHREGIVCRDLNPNNILLNDRGHIQLTYFSRWSEVEDSCDSDAIERMYCAPEVGAITEETEACDWWSLGAVLFELLTGKTLVECHPAGINTHTTLNMPECVSEEARSLIQQLLQFNPLERLGAGVAGVEDIKSHPFFTPVDWAELMR

SEQ ID NO: 3 - DNA, 3201 bp, Homo Sapiens
  CDS (1)...(3201)
atgacctcttaccgggagcggagtgccgacctggcccgtttctacactgtcaccgagccccagcgacacccgaggggctacacagtatataaggtcaccgcccgggttgtttcacgaagaaatccagaggatgtccaggagataattgtatggaagagatacagtgattttaagaaactacacaaagaactatggcaaattcacaaaaacttattccgacattcagagttgtttcctccatttgctaaaggaatagtgtttgggcgatttgatgaaactgttatcgaagagagaagacaatgtgctgaagacctgctacagttctctgccaatattcctgctctttacaatagtaaacagcttgaagactttttcaagggtggaataattaatgatagttctgaattaattggtcctgctgaagctcactcagattccctcattgatacctttcctgagtgtagtacggaaggcttctccagtgacagtgatctggtatctcttactgttgatgtggattctcttgctgagttagatgatggaatggcttccaatcaaaattctcccattagaacttttggtctcaatctttcttcggattcttcagcactaggggctgttgcttctgacagtgaacagagcaaaacagaagaagaacgggaaagtcgtagcctctttcctggcagtttaaagccgaagcttggcaagagagattatttggagaaagcaggagaattaataaagctggctttaaaaaaggaagaagaagacgactatgaagctgcttctgatttttataggaagggagttgatttactcctagaaggtgttcaaggagagtcaagccctacccgtcgagaagctgtgaagagaagaacagccgagtacctcatgcgggcagaaagtatctctagtctttatgggaaacctcagcttgatgatgaatctcagcctccaggatcactaagttcaaggcccctttggaacctaaggagccctgccgaggagctgaaggccttcagagtccttggggtgattgacaaggttttacttgtaatggacacaaggacagaacagactttcattttaaaaggtctaaggaaaagcagtgaatacagcaggaacagaaagaccatcatcccccgctgtgtgcccaacatggtgtgtctgcataagtacatcatctctgaggagtcagtatttcttgtgctgcagcatgcggaaggtggcaaactgtggtcatatatcagtaaatttctaaacagaagtcctgaagaaagctttgacatcaaggaagtgaaaaaacctacacttgcaaaagttcacctgcagcagccaacttctagtcctcaggacagcagtagctttgaatccagaggaagtgatggtggaagcatgcttaaagctctgcctttgaagagtagtcttactccaagttctcaagatgacagcaaccaggaagatgatggccaagatagctctccaaagtggccagattctggttcaagttcagaagaagaatgtactactagttatttaacattatgcaatgaatatgggcaagaaaagattgaaccagggtctttgaatgaggagcccttcatgaagactgaagggaatggtgttgatacaaaagctattaaaagcttcccagcacaccttgctgctgacagtgacagccccagcacacagctgagagctcacgagctgaagttcttccccaacgatgacccagaagcagttagttctccaagaacatcagattccctcagtagatcaaaaaatagccccatggaattctttaggatagacagtaaggatagcgcaagtgaactcctgggacttgactttggagaaaaattgtatagtctaaaatcagaacctttgaaaccattctttactcttccagatggagacagtgcttctaggagttttaatactagtgaaagcaaggtagagtttaaagctcaggacaccattagcaggggctcagatgactcagtgccagttatttcatttaaagatgctgcttttgatgatgtcagtggtactgatgaaggaagacctgatcttcttgtaaatttacctggtgaattggagtcaacaagagaagctgcagcattgggacctactaagtttacacaaactaatatagggataatagaaaataaactcttggaagcccctgatgttttatgcctcaggcttagtactgaacaatgccaagcacatgaggagaaaggcatagaggaactgagtgatccctctgggcccaaatcctatagtataacagagaaacactatgcacaggaggatcccaggatgttatttgtagcagctgttgatcatagtagttcaggagatatgtctttgttacccagctcagatcctaagtttcaaggacttggagtggttgagtcagcagtaactgcaaacaacacagaagaaagcttattccgtatttgtagtccactctcaggtgctaatgaatatattgcaagcacagacactttaaaaacagaagaagtattgctgtttacagatcagactgatgatttggctaaagaggaaccaacttctttattccagagagactctgagactaagggtgaaagtggtttagtgctagaaggagacaaggaaatacatcagatttttgaggaccttgataaaaaattagcactagcctccaggttttacatcccagagggctgcattcaaagatgggcagctgaaatggtggtagcccttgatgctttacatagagagggaattgtgtgccgcgatttgaacccaaacaacatcttattgaatgatagaggacacattcagctaacgtattttagcaggtggagtgaggttgaagattcctgtgacagcgatgccatagagagaatgtactgtgccccagaggttggagcaatcactgaagaaactgaagcctgtgattggtggagtttgggtgctgtcctctttgaacttctcactggcaagactctggttgaatgccatccagcaggaataaatactcacactactttgaacatgccagaatgtgtctctgaagaggctcgctcactcattcaacagctcttgcagttcaatcctctggaacgacttggtgctggagttgctggtgttgaagatatcaaatctcatccattttttacccctgtggattgggcagaactgatgagatga

SEQ ID NO: 4 - DNA, 2438 bp, Homo Sapiens
  CDS (45)...(2123)
gtccggaattcccggggtcgacccacgcgtccgtaagaaatgagatggagaagtacgagcggatccgagtggtggggagaggtgccttcgggattgttcacctgtgcctgcgaaaggctgaccagaagctggtgatcatcaagcagattccagtggaacagatgaccaaggaagagcggcaggcagcccagaatgagtgccaggtcctcaagctgctcaaccaccccaatgtcattgagtactacgagaacttcctggaagacaaagcccttacgatcgccatggaatatgcaccaggcggcactctggctgagttcatccaaaagcgctgtaattccctgctggaggaggagaccatcctgcacttcttcgtgcagatcctgcttgcactgcatcatgtgcacacccacctcatcctgcaccgagacctcaagacccagaacatcctgcttgacaaacaccgcatggtcgtcaagatcggtgatttcggcatctccaagatccttagcagcaagagcaaggcctacacggtggtgggtaccccatgctatatctcccctgagctgtgtgagggcaagccctacaaccagaagagtgacatctgggccctgggctgtgtcctctacgagctggccagcctcaagagggctttcgaggctgcgaacttgccagcactggtgctgaagatcatgagtggcacctttgcacctatctctgaccggtacagccctgagcttcgccagctggtcctgagtctactcagcctggagcctgcccagcggccaccactcagccacatcatggcacagcccctctgcatccgtgccctcctcaacctccacaccgacgtgggcagtgtccgcatgcggagggcagagaagtccgtggcccccagcaacacagggagcaggaccaccagtgtccgctgcagaggtatcccccggggacctgtgaggccagccatcccaccaccactgtcgtcagtgtatgcctggggtggtgggctgggcacccccctgcggctgccaatgctcaacacagaggtggtccaggtggcagctgggcgcacgcagaaagccggcgtcacgcgctctgggcgtctcatcctgtgggaggccccacccctaggtgcaggcggaggcagtctccttcctggggcagtggagcagccacagccccagttcatctcgcgtttcctggagggccagtcgggtgtgaccatcaagcacgtggcctgtggggacttcttcactgcctgcctgactgacagaggcatcatcatgacattcggcagcggcagcaatgggtgcctaggccatggcagcctcactgacatcagccagcccaccattgtggaggctttgctgggctatgaaatggtgcaggtggcctgtggggcctctcacgtgctggccctgtccactgagcgagaactatttgcctggggccgtggagacagcggcagactggggctaggcaccagggagtcccacagctgcccccagcaggtgcccatgcccccaggacaggaagctcagcgagttgtatgtggtatcgattcctccatgatcctcactgtgcctggccaagccctagcctgtgggagcaacaggttcaacaagctgggcctggaccacctctccctgggggaggagcctgtcccccaccagcaagtggaggaggccctgagcttcacactactaggctctgcacccctggaccaggagcctctgctgagtatagacctgggcactgctcactcagctgctgtgactgcctcgggtgattgctacacttttggcagcaatcagcacggacagttgggcaccaatactcgccgaggcagtcgggcaccctgtaaggtccaaggccttgagggcatcaagatggcaatggtagcctgtggggatgccttcactgtagctattggggcagagagcgaagtgtactcttggggcaaaggggcgcgaggtcgattgggaaggagggatgaggatgccggactccctcggccagtgcagttggatgagacacacccttacacggtgacttccgtgtcctgttgccatggaaacaccctcctggctgttcgatcggtcacagatgagccggtccccccctgaggcacccggattcacctctggaccaccctgatattgcttctcctctgaatgctctgaaaagtgcaggtgcccaaggcatgacttgcagctgtctcctggattgtgtcatcatggggtatcagggctggcaaaacccctgctctgcttttggccttggatatggaaacctcaaccactttgttctcctaccacctctttgcccttcctaccccttcctcccttcagtcagtgtccccagggtccagcctggctagagttagaaggcagacctagcctttggaagcagggtggcctccagagccttgccataaaaag

SEQ ID NO: 5 - protein, 692 aa, Homo Sapiens
MEKYERIRVVGRGAFGIVHLCLRKADQKLVIIKQIPVEQMTKEERQAAQNECQVLKLLNHPNVIEYYENFLEDKALTIAMEYAPGGTLAEFIQKRCNSLLEEETILHFFVQILLALHHVHTHLILHRDLKTQNILLDKHRMVVKIGDFGISKILSSKSKAYTVVGTPCYISPELCEGKPYNQKSDIWALGCVLYELASLKRAFEAANLPALVLKIMSGTFAPISDRYSPELRQLVLSLLSLEPAQRPPLSHIMAQPLCIRALLNLHTDVGSVRMRRAEKSVAPSNTGSRTTSVRCRGIPRGPVRPAIPPPLSSVYAWGGGLGTPLRLPMLNTEVVQVAAGRTQKAGVTRSGRLILWEAPPLGAGGGSLLPGAVEQPQPQFISRFLEGQSGVTIKHVACGDFFTACLTDRGIIMTFGSGSNGCLGHGSLTDISQPTIVEALLGYEMVQVACGASHVLALSTERELFAWGRGDSGRLGLGTRESHSCPQQVPMPPGQEAQRVVCGIDSSMILTVPGQALACGSNRFNKLGLDHLSLGEEPVPHQQVEEALSFTLLGSAPLDQEPLLSIDLGTAHSAAVTASGDCYTFGSNQHGQLGTNTRRGSRAPCKVQGLEGIKMAMVACGDAFTVAIGAESEVYSWGKGARGRLGRRDEDAGLPRPVQLDETHPYTVTSVSCCHGNTLLAVRSVTDEPVPP

SEQ ID NO: 6 - DNA, 2079 bp, Homo Sapiens
  CDS (1)...(2079)
atggagaagtacgagcggatccgagtggtggggagaggtgccttcgggattgttcacctgtgcctgcgaaaggctgaccagaagctggtgatcatcaagcagattccagtggaacagatgaccaaggaagagcggcaggcagcccagaatgagtgccaggtcctcaagctgctcaaccaccccaatgtcattgagtactacgagaacttcctggaagacaaagcccttacgatcgccatggaatatgcaccaggcggcactctggctgagttcatccaaaagcgctgtaattccctgctggaggaggagaccatcctgcacttcttcgtgcagatcctgcttgcactgcatcatgtgcacacccacctcatcctgcaccgagacctcaagacccagaacatcctgcttgacaaacaccgcatggtcgtcaagatcggtgatttcggcatctccaagatccttagcagcaagagcaaggcctacacggtggtgggtaccccatgctatatctcccctgagctgtgtgagggcaagccctacaaccagaagagtgacatctgggccctgggctgtgtcctctacgagctggccagcctcaagagggctttcgaggctgcgaacttgccagcactggtgctgaagatcatgagtggcacctttgcacctatctctgaccggtacagccctgagcttcgccagctggtcctgagtctactcagcctggagcctgcccagcggccaccactcagccacatcatggcacagcccctctgcatccgtgccctcctcaacctccacaccgacgtgggcagtgtccgcatgcggagggcagagaagtccgtggcccccagcaacacagggagcaggaccaccagtgtccgctgcagaggtatcccccggggacctgtgaggccagccatcccaccaccactgtcgtcagtgtatgcctggggtggtgggctgggcacccccctgcggctgccaatgctcaacacagaggtggtccaggtggcagctgggcgcacgcagaaagccggcgtcacgcgctctgggcgtctcatcctgtgggaggccccacccctaggtgcaggcggaggcagtctccttcctggggcagtggagcagccacagccccagttcatctcgcgtttcctggagggccagtcgggtgtgaccatcaagcacgtggcctgtggggacttcttcactgcctgcctgactgacagaggcatcatcatgacattcggcagcggcagcaatgggtgcctaggccatggcagcctcactgacatcagccagcccaccattgtggaggctttgctgggctatgaaatggtgcaggtggcctgtggggcctctcacgtgctggccctgtccactgagcgagaactatttgcctggggccgtggagacagcggcagactggggctaggcaccagggagtcccacagctgcccccagcaggtgcccatgcccccaggacaggaagctcagcgagttgtatgtggtatcgattcctccatgatcctcactgtgcctggccaagccctagcctgtgggagcaacaggttcaacaagctgggcctggaccacctctccctgggggaggagcctgtcccccaccagcaagtggaggaggccctgagcttcacactactaggctctgcacccctggaccaggagcctctgctgagtatagacctgggcactgctcactcagctgctgtgactgcctcgggtgattgctacacttttggcagcaatcagcacggacagttgggcaccaatactcgccgaggcagtcgggcaccctgtaaggtccaaggccttgagggcatcaagatggcaatggtagcctgtggggatgccttcactgtagctattggggcagagagcgaagtgtactcttggggcaaaggggcgcgaggtcgattgggaaggagggatgaggatgccggactccctcggccagtgcagttggatgagacacacccttacacggtgacttccgtgtcctgttgccatggaaacaccctcctggctgttcgatcggtcacagatgagccggtccccccctga

SEQ ID NO: 7 - DNA, 1334 bp, Homo Sapiens
  CDS (1)...(1278)
atggccggacggagggatgaggcagggggggcccgggcagcgccgttgctgctccccccgccgcccgcagccatggaaacggggaaggacggcgcccgcagaggtacacaaagcccggagcggaaaaggcgaagcccagtgccgcgggcgcccagcacgaagctgaggccggcggcggcggcccgggccatggatccggtggcggccgaggccccgggcgaggccttcctggcgcggcgacggcctgagggcggtggcgggtccgcgcggccgcgttacagcctgttggcggagatcgggcgcggcagctacggcgtggtttatgaggcagtggccgggcgcagcggggcccgggtggcggtcaagaagatccgctgcgacgcccccgagaacgtggagctggcgctggctgaattctgggccctcaccagcctcaagcggcgccaccagaacgtcgtgcagtttgaggagtgcgtcctgcagcgcaatgggttagcccagcgcatgagtcacggcaacaagagctcgcagctttacctgcgcctggtggagacctcgctgaaaggagaaaggatcctgggttatgctgaggagccctgctatctctggtttgtcatggagttctgtgaaggtggagacctgaatcagtatgtcctgtcccggaggccagacccagccaccaacaaaagtttcatgctacagctgacgagcgccattgcctccctgcacaaaaaccatattgtgcacagggacctgaagccagacaacatcctcatcacagagcggtctggcacccccatcctcaaagtggccgactttggactaagcaaggtctgtgctgggctggcaccccgaggcaaagagggcaatcaagacaacaaaaatgtgaatgtgaataagtactggctgtcctcagcctgcggttcggacttctacatggctcctgaagtctgggagggacactacacagccaaggcggacatctttgccctgggcattatcatctgggcaatgatagaaagaatcacttttattgactctgagaccaagaaggagctcctggggacctacattaaacaggggactgagatcgtccctgttggtgaggcgctgctagaaaacccaaagatggagttgcacatcccccaaaaacgcaggacttccatgtctgaggggatcaagcagctcttgaaagatatgttagctgctaacccacaggaccggcctgatgcctttgaacttgaaaccagaatggaccaggtcacatgtgctgcttaaaattcagggctaagcattttgggtgattttaaactaggtcgattcctcgggaccca

SEQ ID NO: 8 - protein, 425 aa, Homo Sapiens
MAGRRDEAGGARAAPLLLPPPPAAMETGKDGARRGTQSPERKRRSPVPRAPSTKLRPAAAARAMDPVAAEAPGEAFLARRRPEGGGGSARPRYSLLAEIGRGSYGVVYEAVAGRSGARVAVKKIRCDAPENVELALAEFWALTSLKRRHQNVVQFEECVLQRNGLAQRMSHGNKSSQLYLRLVETSLKGERILGYAEEPCYLWFVMEFCEGGDLNQYVLSRRPDPATNKSFMLQLTSAIASLHKNHIVHRDLKPDNILITERSGTPILKVADFGLSKVCAGLAPRGKEGNQDNKNVNVNKYWLSSACGSDFYMAPEVWEGHYTAKADIFALGIIIWAMIERITFIDSETKKELLGTYIKQGTEIVPVGEALLENPKMELHIPQKRRTSMSEGIKQLLKDMLAANPQDRPDAFELETRMDQVTCAA

SEQ ID NO: 9 - DNA, 1278 bp, Homo Sapiens
  CDS (1)...(1278)
atggccggacggagggatgaggcagggggggcccgggcagcgccgttgctgctccccccgccgcccgcagccatggaaacggggaaggacggcgcccgcagaggtacacaaagcccggagcggaaaaggcgaagcccagtgccgcgggcgcccagcacgaagctgaggccggcggcggcggcccgggccatggatccggtggcggccgaggccccgggcgaggccttcctggcgcggcgacggcctgagggcggtggcgggtccgcgcggccgcgttacagcctgttggcggagatcgggcgcggcagctacggcgtggtttatgaggcagtggccgggcgcagcggggcccgggtggcggtcaagaagatccgctgcgacgcccccgagaacgtggagctggcgctggctgaattctgggccctcaccagcctcaagcggcgccaccagaacgtcgtgcagtttgaggagtgcgtcctgcagcgcaatgggttagcccagcgcatgagtcacggcaacaagagctcgcagctttacctgcgcctggtggagacctcgctgaaaggagaaaggatcctgggttatgctgaggagccctgctatctctggtttgtcatggagttctgtgaaggtggagacctgaatcagtatgtcctgtcccggaggccagacccagccaccaacaaaagtttcatgctacagctgacgagcgccattgcctccctgcacaaaaaccatattgtgcacagggacctgaagccagacaacatcctcatcacagagcggtctggcacccccatcctcaaagtggccgactttggactaagcaaggtctgtgctgggctggcaccccgaggcaaagagggcaatcaagacaacaaaaatgtgaatgtgaataagtactggctgtcctcagcctgcggttcggacttctacatggctcctgaagtctgggagggacactacacagccaaggcggacatctttgccctgggcattatcatctgggcaatgatagaaagaatcacttttattgactctgagaccaagaaggagctcctggggacctacattaaacaggggactgagatcgtccctgttggtgaggcgctgctagaaaacccaaagatggagttgcacatcccccaaaaacgcaggacttccatgtctgaggggatcaagcagctcttgaaagatatgttagctgctaacccacaggaccggcctgatgcctttgaacttgaaaccagaatggaccaggtcacatgtgctgcttaa

SEQ ID NO: 10 - DNA, 3301 bp, Homo Sapiens
  CDS (36)...(2816)
cagggacctgccagccgtgcagctgcccaggcgctatggcgagtgcggtcagggggtcgaggccgtggccccggctggggctccagctccagttcgcggcgctgctgctcgggacgctgagtccacaggttcatactctcaggccagagaacctcctgctggtgtccaccttggatggaagtctccacgcactaagcaagcagacaggggacctgaagtggactctgagggatgatcccgtcatcgaaggaccaatgtacgtcacagaaatggcctttctctctgacccagcagatggcagcctgtacatcttggggacccaaaaacaacagggattaatgaaactgccattcaccatccctgagctggttcatgcctctccctgccgcagctctgatggggtcttctacacaggccggaagcaggatgcctggtttgtggtggaccctgagtcaggggagacccagatgacactgaccacagagggtccctccaccccccgcctctacattggccgaacacagtatacggtcaccatgcatgacccaagagccccagccctgcgctggaacaccacctaccgccgctactcagcgccccccatggatggctcacctgggaaatacatgagccacctggcgtcctgcgggatgggcctgctgctcactgtggacccaggaagcgggacggtgctgtggacacaggacctgggcgtgcctgtgatgggcgtctacacctggcaccaggacggcctgcgccagctgccgcatctcacgctggctcgagacactctgcatttcctcgccctccgctggggccacatccgactgcctgcctcaggcccccgggacacagccaccctcttctctaccttggacacccagctgctaatgacgctgtatgtggggaaggatgaaactggcttctatgtctctaaagcactggtccacacaggagtggccctggtgcctcgtggactgaccctggcccccgcagatggccccaccacagatgaggtgacactccaagtctcaggagagcgagagggctcacccagcactgctgttagatacccctcaggcagtgtggccctcccaagccagtggctgctcattggacaccacgagctacccccagtcctgcacaccaccatgctgagggtccatcccaccctggggagtggaactgcagagacaagacctccagagaatacccaggccccagccttcttcttggagctattgagcctgagccgagagaaactttgggactccgagctgcatccagaagaaaaaactccagactcttacttggggctgggaccccaagacctgctggcagctagcctcactgctgtcctcctgggagggtggattctctttgtgatgaggcagcaacagccgcaggtggtggagaagcagcaggagacccccctggcacctgcagactttgctcacatctcccaggatgcccagtccctgcactcgggggccagccggaggagccagaagaggcttcagagtccctcaaagcaagcccagccactcgacgaccctgaagctgagcaactcaccgtagtggggaagatttccttcaatcccaaggacgtgctgggccgcggggcaggcgggactttcgttttccggggacagtttgagggacgggcagtggctgtcaagcggctcctccgcgagtgctttggcctggttcggcgggaagttcaactgctgcaggagtctgacaggcaccccaacgtgctccgctacttctgcaccgagcggggaccccagttccactacattgccctggagctctgccgggcctccttgcaggagtacgtagaaaacccggacctggatcgcgggggtctggagcccgaggtcgtgctgcagcagctgatgtctggcctggcccacctgcactctttacacatagtgcaccgggacctgaagccaggaaatattctcatcaccgggcctgacagccagggcctgggcagagtggtgctctcagacttcggcctctgcaagaagctgcctgctggccgctgtagcttcagcctccactccggcatccccggcacggaaggctggatggcgcccgagcttctgcagctcctgccaccagacagtcctaccagcgctgtggacatcttctctgcaggctgcgtgttctactacgtgctttctggtggcagccacccctttggagacagtctttatcgccaggcaaacatcctcacaggggctccctgtctggctcacctggaggaagaggtccacgacaaggtggttgcccgggacctggttggagccatgttgagcccactgccacagccacgcccctctgccccccaggtgctggcccaccccttcttttggagcagagccaagcaactccagttcttccaggacgtcagtgactggctggagaaggagtccgagcaggagcccctggtgagggcactggaggcgggaggctgcgcagtggtccgggacaactggcacgagcacatctccatgccgctgcagacagatctgagaaagttccggtcctataaggggacatcagtgcgagacctgctccgtgctgtgaggaacaagaagcaccactacagggagctcccagttgaggtgcgacaggcactcggccaagtccctgatggcttcgtccagtacttcacaaaccgcttcccacggctgctcctccacacgcaccgagccatgaggagctgcgcctctgagagcctcttcctgccctactacccgccagactcagaggccaggaggccatgccctggggccacagggaggtgaggtgggctggatgccacacagatggtctccgtgctggctcactgaagagctgagcctgtggctggcctcagaatcaggctgggtgcagtggctcacacctgtaatcccagcattttgggaggctgagtgagaggatcacttgagctcaggagttcgagaccagcctggccaacatggcaacaccccatttctacaaaaaatttgtaaaattagccaggcatggtggcgcacgcctgtagtcccagctgcttgggaggctgaggtgggagaatcacttgagcccaggagttcgaggctgcagtgagccaggatcatgccactgcactccagcctggtccacagagagacactgtcaccccctttcccccacaagactggcagaggctgggcagcctggggctgatgaagcagagatgttcgctggatcccaggccctggcacccctcaggaaatacaagaaaaagaatattcaaaaaaaaaaaaaa

SEQ ID NO: 11 - protein, 926 aa, Homo Sapiens
MASAVRGSRPWPRLGLQLQFAALLLGTLSPQVHTLRPENLLLVSTLDGSLHALSKQTGDLKWTLRDDPVIEGPMYVTEMAFLSDPADGSLYILGTQKQQGLMKLPFTIPELVHASPCRSSDGVFYTGRKQDAWFVVDPESGETQMTLTTEGPSTPRLYIGRTQYTVTMHDPRAPALRWNTTYRRYSAPPMDGSPGKYMSHLASCGMGLLLTVDPGSGTVLWTQDLGVPVMGVYTWHQDGLRQLPHLTLARDTLHFLALRWGHIRLPASGPRDTATLFSTLDTQLLMTLYVGKDETGFYVSKALVHTGVALVPRGLTLAPADGPTTDEVTLQVSGEREGSPSTAVRYPSGSVALPSQWLLIGHHELPPVLHTTMLRVHPTLGSGTAETRPPENTQAPAFFLELLSLSREKLWDSELHPEEKTPDSYLGLGPQDLLAASLTAVLLGGWILFVMRQQQPQVVEKQQETPLAPADFAHISQDAQSLHSGASRRSQKRLQSPSKQAQPLDDPEAEQLTVVGKISFNPKDVLGRGAGGTFVFRGQFEGRAVAVKRLLRECFGLVRREVQLLQESDRHPNVLRYFCTERGPQFHYIALELCRASLQEYVENPDLDRGGLEPEVVLQQLMSGLAHLHSLHIVHRDLKPGNILITGPDSQGLGRVVLSDFGLCKKLPAGRCSFSLHSGIPGTEGWMAPELLQLLPPDSPTSAVDIFSAGCVFYYVLSGGSHPFGDSLYRQANILTGAPCLAHLEEEVHDKVVARDLVGAMLSPLPQPRPSAPQVLAHPFFWSRAKQLQFFQDVSDWLEKESEQEPLVRALEAGGCAVVRDNWHEHISMPLQTDLRKFRSYKGTSVRDLLRAVRNKKHHYRELPVEVRQALGQVPDGFVQYFTNRFPRLLLHTHRAMRSCASESLFLPYYPPDSEARRPCPGATGR

SEQ ID NO: 12 - DNA, 2781 bp, Homo Sapiens
  CDS (1)...(2781)
atggcgagtgcggtcagggggtcgaggccgtggccccggctggggctccagctccagttcgcggcgctgctgctcgggacgctgagtccacaggttcatactctcaggccagagaacctcctgctggtgtccaccttggatggaagtctccacgcactaagcaagcagacaggggacctgaagtggactctgagggatgatcccgtcatcgaaggaccaatgtacgtcacagaaatggcctttctctctgacccagcagatggcagcctgtacatcttggggacccaaaaacaacagggattaatgaaactgccattcaccatccctgagctggttcatgcctctccctgccgcagctctgatggggtcttctacacaggccggaagcaggatgcctggtttgtggtggaccctgagtcaggggagacccagatgacactgaccacagagggtccctccaccccccgcctctacattggccgaacacagtatacggtcaccatgcatgacccaagagccccagccctgcgctggaacaccacctaccgccgctactcagcgccccccatggatggctcacctgggaaatacatgagccacctggcgtcctgcgggatgggcctgctgctcactgtggacccaggaagcgggacggtgctgtggacacaggacctgggcgtgcctgtgatgggcgtctacacctggcaccaggacggcctgcgccagctgccgcatctcacgctggctcgagacactctgcatttcctcgccctccgctggggccacatccgactgcctgcctcaggcccccgggacacagccaccctcttctctaccttggacacccagctgctaatgacgctgtatgtggggaaggatgaaactggcttctatgtctctaaagcactggtccacacaggagtggccctggtgcctcgtggactgaccctggcccccgcagatggccccaccacagatgaggtgacactccaagtctcaggagagcgagagggctcacccagcactgctgttagatacccctcaggcagtgtggccctcccaagccagtggctgctcattggacaccacgagctacccccagtcctgcacaccaccatgctgagggtccatcccaccctggggagtggaactgcagagacaagacctccagagaatacccaggccccagccttcttcttggagctattgagcctgagccgagagaaactttgggactccgagctgcatccagaagaaaaaactccagactcttacttggggctgggaccccaagacctgctggcagctagcctcactgctgtcctcctgggagggtggattctctttgtgatgaggcagcaacagccgcaggtggtggagaagcagcaggagacccccctggcacctgcagactttgctcacatctcccaggatgcccagtccctgcactcgggggccagccggaggagccagaagaggcttcagagtccctcaaagcaagcccagccactcgacgaccctgaagctgagcaactcaccgtagtggggaagatttccttcaatcccaaggacgtgctgggccgcggggcaggcgggactttcgttttccggggacagtttgagggacgggcagtggctgtcaagcggctcctccgcgagtgctttggcctggttcggcgggaagttcaactgctgcaggagtctgacaggcaccccaacgtgctccgctacttctgcaccgagcggggaccccagttccactacattgccctggagctctgccgggcctccttgcaggagtacgtagaaaacccggacctggatcgcgggggtctggagcccgaggtcgtgctgcagcagctgatgtctggcctggcccacctgcactctttacacatagtgcaccgggacctgaagccaggaaatattctcatcaccgggcctgacagccagggcctgggcagagtggtgctctcagacttcggcctctgcaagaagctgcctgctggccgctgtagcttcagcctccactccggcatccccggcacggaaggctggatggcgcccgagcttctgcagctcctgccaccagacagtcctaccagcgctgtggacatcttctctgcaggctgcgtgttctactacgtgctttctggtggcagccacccctttggagacagtctttatcgccaggcaaacatcctcacaggggctccctgtctggctcacctggaggaagaggtccacgacaaggtggttgcccgggacctggttggagccatgttgagcccactgccacagccacgcccctctgccccccaggtgctggcccaccccttcttttggagcagagccaagcaactccagttcttccaggacgtcagtgactggctggagaaggagtccgagcaggagcccctggtgagggcactggaggcgggaggctgcgcagtggtccgggacaactggcacgagcacatctccatgccgctgcagacagatctgagaaagttccggtcctataaggggacatcagtgcgagacctgctccgtgctgtgaggaacaagaagcaccactacagggagctcccagttgaggtgcgacaggcactcggccaagtccctgatggcttcgtccagtacttcacaaaccgcttcccacggctgctcctccacacgcaccgagccatgaggagctgcgcctctgagagcctcttcctgccctactacccgccagactcagaggccaggaggccatgccctggggccacagggaggtga

SEQ ID NO: 13 - protein, 35 aa, Artificial Sequence
  Consensus amino acid sequence
PNIVRLLGVFEDTDDHLYLVMEYMEGGDLFDYLRR

SEQ ID NO: 14 - protein, 186 aa, Artificial Sequence
  Consensus amino acid sequence
AKKIALQILRGLEYLHSNGIVHRDLKPENILLDENGTVKIADFGLARLLEKLTTFVGTPWYMMAPEVILEGRGYSSKVDVWSLGVILYELLTGGPLFPGADLPAFTGGDEVDQLIIFVLKLPFSDELPKTRIDPLEELFRIKKRRLPLPSNCSEELKDLLKKCLNKDPSKRPGSATAKEILNHPWF

SEQ ID NO: 15 - protein, 201 aa, Artificial Sequence
  Consensus amino acid sequence
MGPTKFTQTNIGIIENKLLEAPDVLCLRLSTEQCQAHEEKGIEELSDPSGPKSYSITEKHYAQEDPRMLFVAAVDHSSSGDMSLLPSSDPKFQGLGVVESAVTANNTEESLFRICSPLSGANEYIASTDTLKTEEVLLFTDQTDDLAKEEPTSLFQRDSETKGESGLVLEGDKEIHQIFEDLDKKLALASRFYIPEGCIQR

SEQ ID NO: 16 - protein, 110 aa, Artificial Sequence
  Consensus amino acid sequence
MEFFRIDSKDSASELLGLDFGEKLYSLKSEPLKPFFTLPDGDSASRSFNTSESKVEFKAQDTISRGSDDSVPVISFKDAAFDDVSGTDEGRPDLLVNLPGELESTREAAA

SEQ ID NO: 17 - protein, 278 aa, Artificial Sequence
  Consensus amino acid sequence
YELLEKLGEGSFGKVYKAKHKTGKIVAVKILKKESLSLREIQILKRLSHPNIVRLLGVFEDTDDHLYLVMEYMEGGDLFDYLRRNGPLSEKEAKKIALQILRGLEYLHSNGIVHRDLKPENILLDENGTVKIADFGLARLLEKLTTFVGTPWYMMAPEVILEGRGYSSKVDVWSLGVILYELLTGGPLFPGADLPAFTGGDEVDQLIIFVLKLPFSDELPKTRIDPLEELFRIKKRRLPLPSNCSEELKDLLKKCLNKDPSKRPGSATAKEILNHPWF

SEQ ID NO: 18 - protein, 95 aa, Artificial Sequence
  Consensus amino acid sequence
IACGAHHTAALTSSGGEVYTWGSGEYGQLGHGNSEEENQMKPTMVEALLQSKLENEKVVQVACGSNHTLALTESTEDGEVYTWGSNDHGQLGLGT

SEQ ID NO: 19 - protein, 112 aa, Artificial Sequence
  Consensus amino acid sequence
KSPVVDIACGAHHTAALTSSGGEVYTWGSGEYGQLGHGNSEEENQMKPTMVEALLQSKLENEKVVQVACGSNHTLALTESTEDGEVYTWGSNDHGQLGLGTFLANGVLPTPV

SEQ ID NO: 20 - protein, 95 aa, Artificial Sequence; identical to SEQ ID NO: 18
  Consensus amino acid sequence

SEQ ID NO: 21 - protein, 108 aa, Artificial Sequence
  Consensus amino acid sequence
VVDIACGAHHTAALTSSGGEVYTWGSGEYGQLGHGNSEEENQMKPTMVEALLQSKLENEKVVQVACGSNHTLALTESTEDGEVYTWGSNDHGQLGLGTFLANGVLPTP

SEQ ID NO: 22 - protein, 80 aa, Artificial Sequence
  Consensus amino acid sequence
IACGAHHTAALTSSGGEVYTWGSGEYGQLGHGNSEEENQMKPTMVEALLQSKLENEKVVQVACGSNHTLALTESTEDGEV

SEQ ID NO: 23 - protein, 118 aa, Artificial Sequence
  Consensus amino acid sequence
LKLTKSKSPVVDIACGAHHTAALTSSGGEVYTWGSGEYGQLGHGNSEEENQMKPTMVEALLQSKLENEKVVQVACGSNHTLALTESTEDGEVYTWGSNDHGQLGLGTFLANGVLPTPV

SEQ ID NO: 24 - protein, 123 aa, Artificial Sequence
  Consensus amino acid sequence
DKYELLEKIGCGSFGIIRKVRRKADGFILCRKEINYIKMSQKEREQLHAEFNILSTLRHPNIVGYYHREHLKATQDLHLYMEYCGNGDLGRVIRNLKRNNQYAEEDFVWRIFSQLVTALYRCH

SEQ ID NO: 25 - protein, 193 aa, Artificial Sequence
  Consensus amino acid sequence
EKYTLYNDEFMGKGAYSQVYRGRTESGRLVAVKTACKTASNKADVDAMCTEIDILKKLKGAANIVQYFGSNHTKMPPGSVTIETISFAMECASRSLDAEMRRPENHRGLPSNALIDLVVDCSMALSALREHNIAHRDIKHMNILLFPGTPTRGRRSTHLFKLCDMGCSKAISENSSHEMNTIAGTPNFLHPFL

SEQ ID NO: 26 - protein, 23 aa, Artificial Sequence
  Consensus amino acid sequence
EQCDLWALGCTLYFCATGEFPFE

SEQ ID NO: 27 - protein, 272 aa, Artificial Sequence
  Consensus amino acid sequence
YELLEKLGEGSFGKVYKAKHKTGKIVAVKILKKESLSLREIQILKRLSHPNIVRLLGVFEDTDDHLYLVMEYMEGGDLFDYLRRNGPLSEKEAKKIALQILRGLEYLHSNGIVHRDLKPENILLDENGTVKIADFGLARLLEKLTTFVGTPWYMMAPEVILEGRGYSSKVDVWSLGVILYELLTGGPLFPGADLPAFTGGDEVDQLIIFVLKLPFSDELPKTRIDPLEELFRIKKRRLPLPSNCSEELKDLLKKCLNKDPSKRPGSATAKEI

SEQ ID NO: 28 - protein, 194 aa, Artificial Sequence
  Consensus amino acid sequence
QIAKGLEYLHSKSNKQNIIHRDLKPENILLDNNMVAKGDSEIKVVKIADFGLARMIEESSEESSSSSSSTTTQYTVTGTGTPSYVKYVGTRWYMAPEVLMGSSYGQYSEKSDVWSGVILYELLTGKPPFFPGSSEVNDSQMNEIMKETMVKSAEYEMPMKMPMPESSKESMSCPSMSSEAVKDLIKKCWQKDPE

SEQ ID NO: 29 - protein, 180 aa, Artificial Sequence
  Consensus amino acid sequence
IHRDLKPENILLDNNMVAKGDSEIKVVKIADFGLARMIEESSEESSSSSSSTTTQYTVTGTGTPSYVKYVGTRWYMAPEVLMGSSYGQYSEKSDVWSFGVILYELLTGKPPFFPGSSEVNDSQMNEIMKETMVKSAEYEMPMKMPMPESSKESMSCPSMSSEAVKDLIKKCWQKDPEKRP

SEQ ID NO: 30 - protein, 130 aa, Artificial Sequence
  Consensus amino acid sequence
YELLKKLGEGSFGKVYKARHKVVYKAKDKSKETYAAKVVAKLKVLKAATKVAVKKKMKEEEKKESKTSMREEEMQMMMEIETHPNIMIIRHVNLVVVMGYCTYEESEEEDENKLYIVMEYMNGGSLEDYL

SEQ ID NO: 31 - protein, 278 aa, Artificial Sequence; identical to SEQ ID NO: 17
  Consensus amino acid sequence

SEQ ID NO: 32 - protein, 109 aa, Artificial Sequence
  Consensus amino acid sequence
PETLLFVSTIDGRLHALDKETGEIKWTLKEDPVLQSPSHVKQGPHFLPDPRDGSLYVLGTHKNGSLKKLPFTIPQLVHASPCRSSDGILYSGKKQDVWYMVDPKTGRKE

SEQ ID NO: 33 - protein, 236 aa, Artificial Sequence
  Consensus amino acid sequence
SRQTIYLGRTQYTVSMYDSKTRNKDAKPWNATFYDYSAHLLPPELANEWEYSHYTSTSHGYIVTLDREHGEFLWQQDLSSPVVALYLWRPDGLHKVPFTTVGKETYQNILENSKTVDQWPTVWGVNAADPQGTSLTTKLFPSLYVGEHQKGLYALPSLVDHNTVRISPRAPPIPLLDGPTPDAVTEMEKGEYLPPPRPIVRNIPPSVTHKTLNYLDGEWLLIGYHDRPMMTMTTML

SEQ ID NO: 34 - protein, 128 aa, Artificial Sequence
  Consensus amino acid sequence
GKVSAETRASEDLHAPPVFFELLNLRREDPELHPEEKASDSYPGLGSQDLLAATFTAILLGAWVLYLMRQQQQSPSAPAGPPDLSQDAQGQLSRDILQDQRRFQSPSEPAQPPHDPEAGQPTVVGKIS

SEQ ID NO: 35 - protein, 130 aa, Artificial Sequence
  Consensus amino acid sequence
LENRDWPGPLLKTLESGSRVVVESGDWTEKLDKTFVDNLEKYAQAQPGQESRQYNRSYKGWSIRDLLRALRNKKHHYRELLDPPEVREMLGDIPDGFTNYFTSRFPNLLLHVYHAIKEHCSNEEVFKKYF

SEQ ID NO: 36 - protein, 98 aa, Artificial Sequence
  Consensus amino acid sequence
WDSEKRLSFLRDVSDRIELENRDWPGPLLKTLESGSRVVVESGDWTEKLDKTFVDNLEKYAQAQPGQESRQYNRSYKGWSIRDLLRALRNKKHHYREL

SEQ ID NO: 37 - protein, 270 aa, Artificial Sequence
  Consensus amino acid sequence
  VARIANT (1)...(270): Xaa = Any Amino Acid
XXXXXXXXXGXGXXXXVXXXXXXXXXXXXKXXXXXXXXXXXXXXXXXXXEXXXXXXXXXXXXXXXXXXXXXXXXXXXXXXXXXXXXXXXXXXXXXXXXXXXXXXXXXXXXXXXXXXHXXXXXXXXHRDXKXXNXXXXXXXXXXXXXXXXXKXXDFGXXXXXXXXXXXXXXXXXXXXXPXXXXXXXXXXXXXWXXXGXXXXXXXXXXXXXXXXXXXXXXXXXXXXXXXXXXXXXXXXXXXXXXXXXXXXXXXRXXXXXXXXXXXXXXHXXX

SEQ ID NO: 38 - protein, 30 aa, Artificial Sequence
  Consensus amino acid sequence
  VARIANT (1)...(30): Xaa = Any Amino Acid
GXGXXGXXXXXXXXXXXXXXXXXXXXXXXK

SEQ ID NO: 39 - DNA, 2745 bp, Homo Sapiens
  CDS (270)...(2267)
cgcgaggcgcctccgccgccggggcaacggccacgaactacacttcccgacacgccgcgtgaggcgctgccagcggccggccgagggcgggcggacgcgggagctgcggacgtgaggcatgagcggcgccctcctccggcccgcgagcgtcctgctggttccccgagcgagggtctcgcggcgcggggcctagcggagggcatcgaaggcctccgcgtgcgcacgggttgctgcggccgcgccgggcgccggggagggcggcggccgccatggaggtgagcgggccggaagacgaccccttcctttcgcagctgcaccaggtgcagtgccccgtgtgccagcagatgatgcccgccgcgcacatcaactcgcacctggaccgctgtctgctgctccacccggcggggcacgcggagcccgcggccgggtcgcaccgcgccggggagcgggccaaggggccctcgccgcccggcgccaagaggcggcggctgtcggagagctcggcgctgaagcagccagccaccccgacggcagccgagagcagcgagggcgagggtgaggagggcgacgacggcggcgagaccgagagccgcgagagctacgacgcgccgcccacacccagcggcgcccgccttatccccgacttcccggtggcccgctccagcagccccgggaggaaggggtcggggaagaggccggcggccgccgccgcggcggggagcgcgtctccgcgcagctgggacgaggcggaggcgcaggaggaggaggaggccgtgggcgacggcgatggcgacggggacgcggacgcggacggcgaggacgacccggggcactgggacgcggacgctgccgaagccgccaccgccttcggggccagtggcgggggccgcccgcacccccgggcgctggctgccgaggagatccgacagatgctacagggcaagccgctggccgacacgatgcgtcctgacacgctgcaggattacttcgggcagagcaaggccgtgggccaggataccctgctgcgctcgctcctggagaccaacgaaatcccctcgcttatcctgtgggggccgccgggctgcggcaagaccactctggctcacatcatagccagcaacagcaagaaacatagcataaggtttgtgacattatctgcaacaaatgccaagacaaatgatgtgcgagatgtcataaaacaagctcaaaatgaaaagagctttttcaaaaggaaaaccatcctttttattgatgagattcatcggttcaataaatctcagcaggacactttccttcctcacgtggaatgtgggacgatcactctgattggggcaaccactgaaaacccttccttccaggtcaacgctgctcttctgagccgctgtcgagtgattgttcttgagaagcttccagtagaggcaatggtgactattttaatgcgagcgatcaactccctgggaatccacgtcctagactctagccgtcccactgaccctctgagccacagcagcaacagcagctcagagcccgccatgttcatagaggataaagcagtagacaccctggcttacctcagtgacggtgacgcccgagctgggttgaacggactgcagctggcggtgctggctaggttaagctctaggaagatgttctgtaagaagagtgggcaatcctattctcccagtagagttctgatcacagagaatgacgtgaaggagggcctacagcgatcccacattttatatgaccgggcaggtgaggagcattacaactgcatctccgccctgcacaagtccatgcggggctcagaccagaacgcctccctctactggctggctcgcatgctcgagggaggagaggacccactctacgtggcacggaggcttgtcaggtttgccagcgaggacataggtctggcagacccgtctgcgttaacacaagcggttgctgcctaccaaggctgtcattttataggcatgcctgaatgtgaggtgcttctggcccagtgtgtggtctactttgccagagccccaaagtccattgaggtgtacagcgcctacaacaacgtcaaagcctgcctgaggaaccaccaggggccactgccccccgtgcccctgcacctgaggaacgcgcccactaggctgatgaaggatttgggctatggcaaaggctacaagtacaaccccatgtacagcgagcctgtggatcaggagtacctgcctgaagagttgaggggggtagatttcttcaagcagaggaggtgctgactcctcagggcacgacagcagaaggatgttgcttttttaagggagggccagaaagaaagttagtggattgcaaagttggttgcctggtggaagttagamcagaccaacattttgtgccagaaatttaagagttccataggtgggaggcgcagttctttcgaataaatgtgtaactttgaaattgtgttcatttgcactcggtgcagcggttatgcttatgaaaatacctggcagctttgtgcaatgaattaatgttataaggaattatctattttgtcatagtatttaagtcataatgtcatttcagaattcagttctgtaggattttcttttctttaaaaaatgtatattctgggtagttttaattggtaaaaaaatgtaattgtgatttaatactgcatagtgttttgggtattttttttatatgcaaaggtcttacgagccaataaaactatttcaaagtaaaaaaaaaaaaaaa

SEQ ID NO: 40 - protein, 665 aa, Homo Sapiens
MEVSGPEDDPFLSQLHQVQCPVCQQMMPAAHINSHLDRCLLLHPAGHAEPAAGSHRAGERAKGPSPPGAKRRRLSESSALKQPATPTAAESSEGEGEEGDDGGETESRESYDAPPTPSGARLIPDFPVARSSSPGRKGSGKRPAAAAAAGSASPRSWDEAEAQEEEEAVGDGDGDGDADADGEDDPGHWDADAAEAATAFGASGGGRPHPRALAAEEIRQMLQGKPLADTMRPDTLQDYFGQSKAVGQDTLLRSLLETNEIPSLILWGPPGCGKTTLAHIIASNSKKHSIRFVTLSATNAKTNDVRDVIKQAQNEKSFFKRKTILFIDEIHRFNKSQQDTFLPHVECGTITLIGATTENPSFQVNAALLSRCRVIVLEKLPVEAMVTILMRAINSLGIHVLDSSRPTDPLSHSSNSSSEPAMFIEDKAVDTLAYLSDGDARAGLNGLQLAVLARLSSRKMFCKKSGQSYSPSRVLITENDVKEGLQRSHILYDRAGEEHYNCISALHKSMRGSDQNASLYWLARMLEGGEDPLYVARRLVRFASEDIGLADPSALTQAVAAYQGCHFIGMPECEVLLAQCVVYFARAPKSIEVYSAYNNVKACLRNHQGPLPPVPLHLRNAPTRLMKDLGYGKGYKYNPMYSEPVDQEYLPEELRGVDFFKQRRC

SEQ ID NO: 41 - DNA, 1998 bp, Homo Sapiens
  CDS (1)...(1998)
atggaggtgagcgggccggaagacgaccccttcctttcgcagctgcaccaggtgcagtgccccgtgtgccagcagatgatgcccgccgcgcacatcaactcgcacctggaccgctgtctgctgctccacccggcggggcacgcggagcccgcggccgggtcgcaccgcgccggggagcgggccaaggggccctcgccgcccggcgccaagaggcggcggctgtcggagagctcggcgctgaagcagccagccaccccgacggcagccgagagcagcgagggcgagggtgaggagggcgacgacggcggcgagaccgagagccgcgagagctacgacgcgccgcccacacccagcggcgcccgccttatccccgacttcccggtggcccgctccagcagccccgggaggaaggggtcggggaagaggccggcggccgccgccgcggcggggagcgcgtctccgcgcagctgggacgaggcggaggcgcaggaggaggaggaggccgtgggcgacggcgatggcgacggggacgcggacgcggacggcgaggacgacccggggcactgggacgcggacgctgccgaagccgccaccgccttcggggccagtggcgggggccgcccgcacccccgggcgctggctgccgaggagatccgacagatgctacagggcaagccgctggccgacacgatgcgtcctgacacgctgcaggattacttcgggcagagcaaggccgtgggccaggataccctgctgcgctcgctcctggagaccaacgaaatcccctcgcttatcctgtgggggccgccgggctgcggcaagaccactctggctcacatcatagccagcaacagcaagaaacatagcataaggtttgtgacattatctgcaacaaatgccaagacaaatgatgtgcgagatgtcataaaacaagctcaaaatgaaaagagctttttcaaaaggaaaaccatcctttttattgatgagattcatcggttcaataaatctcagcaggacactttccttcctcacgtggaatgtgggacgatcactctgattggggcaaccactgaaaacccttccttccaggtcaacgctgctcttctgagccgctgtcgagtgattgttcttgagaagcttccagtagaggcaatggtgactattttaatgcgagcgatcaactccctgggaatccacgtcctagactctagccgtcccactgaccctctgagccacagcagcaacagcagctcagagcccgccatgttcatagaggataaagcagtagacaccctggcttacctcagtgacggtgacgcccgagctgggttgaacggactgcagctggcggtgctggctaggttaagctctaggaagatgttctgtaagaagagtgggcaatcctattctcccagtagagttctgatcacagagaatgacgtgaaggagggcctacagcgatcccacattttatatgaccgggcaggtgaggagcattacaactgcatctccgccctgcacaagtccatgcggggctcagaccagaacgcctccctctactggctggctcgcatgctcgagggaggagaggacccactctacgtggcacggaggcttgtcaggtttgccagcgaggacataggtctggcagacccgtctgcgttaacacaagcggttgctgcctaccaaggctgtcattttataggcatgcctgaatgtgaggtgcttctggcccagtgtgtggtctactttgccagagccccaaagtccattgaggtgtacagcgcctacaacaacgtcaaagcctgcctgaggaaccaccaggggccactgccccccgtgcccctgcacctgaggaacgcgcccactaggctgatgaaggatttgggctatggcaaaggctacaagtacaaccccatgtacagcgagcctgtggatcaggagtacctgcctgaagagttgaggggggtagatttcttcaagcagaggaggtgctga

SEQ ID NO: 42 - protein, 22 aa, Artificial Sequence
  Consensus amino acid sequence
LLGPPGAGKIVGMGGIGKTTLA

SEQ ID NO: 43 - protein, 219 aa, Artificial Sequence
  Consensus amino acid sequence
GVLLYGPPGTGKTLLAKAVANELGSLRKAPFISISGYSELVSKYVGESEKRVRALFELARELRKRAAPCPIIFIDEIDAIAPKRGGEVSRRVVNQLLTEMDLERAGFSKNSSRGEDTIDLSNVLVIAATNRPDTLDPALLRPGRFDREIEIPLPPDEEGRLDILKIHLKKMPLSSSKQSELAEDVDLDELAEEIATRTEGFSGADLKALCREAALRAIR

SEQ ID NO: 44 - protein, 92 aa, Artificial Sequence
  Consensus amino acid sequence
PGEVVLLVGPPGSGKTTLARALARLLGPGVIYIDGEGGQRIRLALALARKDVLLLDEITSLLDVTVIATTNDLDPALLRRRFDRRIVLLRIL

SEQ ID NO: 45 - protein, 219 aa, Artificial Sequence
  Consensus amino acid sequence
GFKLRPYQKEAIPWLLEGRDVILAAPTGSGKTLAFLLPLLELLKKGKPLASKKGKGPRVLVLVPTRELAEQWAEELKKLGPSLGVYFVEVLKVVGLYGGSKTKEKEQLRKLKSGKTDILVTTPGRLLDLLNGKGLSLNLDLVILDEAHRLLDMGSGGDHGFGDQLELLKRLPKNRQRLLLSATPPEIENLLKLFLNLPELFPNPVFISVGFTLEPIEQF

SEQ ID NO: 46 - protein, 163 aa, Artificial Sequence
  Consensus amino acid sequence
IEEEALDYLANYTDGDARRALNALEIAADMAQERTNGEKDITIEDIEEVLQEKSARYDKDGDQHYDLISAFHKSVRGSDPDAALYWLARMLEGGEDPLYIARRLIRIASFDIGLADPSALPLAVAAWQAVQRIGMPEAEIALAQCVVYLACAPKSNAVYRAFN

SEQ ID NO: 47 - protein, 100 aa, Artificial Sequence
  Consensus amino acid sequence
KQDFLLPYLENGMILLIGATTENPSFELNNALLSRCLVFVLKPLTKDDIKTVLQRAALDDSERGLGGMPNPIEIEEEALDYLANYTDGDARRALNALEIA

SEQ ID NO: 48 - protein, 50 aa, Artificial Sequence
  Consensus amino acid sequence
VPMHLRNAPTKLMKELGYGKGYKYNPDYPDGYVAGQDYLPPELLEKQYYR

SEQ ID NO: 49 - protein, 63 aa, Artificial Sequence
  Consensus amino acid sequence
LLLYGPPGLGKTTLAHIIAHEMGVNIKITSGPALEKPGDLAGLLTNYLEEGDVLFIDEIHRLN

SEQ ID NO: 50 - protein, 96 aa, Artificial Sequence
  Consensus amino acid sequence
EQLRKMRAISLSEPLSEKVRPKSFKDIVGQEDGIKALKAALCGPNPQHVIVYGPPGVGKTAAARLVLEEAKKHKQSPFKEQAVFVELDATTARFDE

SEQ ID NO: 51 - protein, 41 aa, Artificial Sequence
  Consensus amino acid sequence
VLFIDEIGELHPIQMNKMLKVLEDRKVFLDSAYYSEENTQI

SEQ ID NO: 52 - protein, 71 aa, Artificial Sequence
  Consensus amino acid sequence
REIAEREQRRIERRLRMAKLPHQKTLEDFDFTAAPGLDRRTIRELATLDWIERGENIILLGPPGVGKTHLA

SEQ ID NO: 53 - protein, 113 aa, Artificial Sequence
  Consensus amino acid sequence
KDKKVEFLNTSRTYFKVSSKKELIKEASIESSFSFSNEKILGIKQYLAFNSAKKSTIDFFIDETISSFFISIKIKWPSKIDLDKKTLKKCNPDYLLEYSALEIPVFEITKGTN

SEQ ID NO: 54 - DNA, 1591 bp, Homo Sapiens
ttaagcttgcggccgcctccctcccacgcgtccgcctgagcgtagcagaggtggccgcgaccacagccacccctgacggaggccccagagcgactgcaacaaaaggagccggggtacactcgggcgagaggccccctcactccctctctagtaatgcaagaactgcggtccccagcccggtggaggcagcggcggcgagcgatcccgcggcggcccgcaatggactggccgagggcaccgagcaggaggaggaggaggaagacgagcaggtgcggctgctgtcttcgtccctgaccgccgactgcagcttaagaagcccttcgggcagggaggttgagcctggggaggatcggacgatacgatatgtccgatatgaatccgagctacaaatgcccgatatcatgagactgatcaccaaagatctgtccgaaccctactccatttatacctatagatattttatccacaactggccacagctgtgcttcttggccatggtaggggaggagtgtgtaggtgccatcgtttgcaagttggatatgcacaaaaagatgttccgcagaggttatatagccatgttagccgtggattccaaatacaggagaaatggcattggtactaacttggttaagaaagctatatatgccatggttgagggagactgtgatgaggttgttttggaaaccgaaataacaaataagtccgctttgaaactttatgaaaatcttggttttgttcgagataagaggctgttcagatactatttaaatggagttgatgcactgcgacttaaactgtggctgcgttgagaaactgacatcaaggaacaactatcatccacacagaatcgacctttgcatgcaatgcaatttgtacagaattgctttgcaggtggatttagtaatttccatgcagctcttacctgtcagtgtctcattgagtgtcgcacaatatttgttgcactttggcatggcacatttgttctgaattaaaagattgttttaaacttcaggagttcttttggtaccaacaagatgtgccagttgatagccaagatttatgtgttcatttgcaaagtctgctgacaatgttatttacacagtgatcattttatcacagaaccagtaagtggaacataatttttgttccttaaaaaagccaatgtggattgtaaaagtctttaagtatactaacatttcacacaaaacctgccctagttttctgaagtgggtgagggagacgcttcagttttaggttttattttttcaatattaaattttccattcttgaatattggtacctcagtgattagtgaatgaaaaaaatgtagggtgggtatgtcttacaatgagtaaaggtaacaattaaattttgtctgccagtgcctgtgtagataagtatatttgtcttcatctctagtttttgaatgcatgctatcttttccttttctttaaggcctttgcaagcaaacttttgtttttatttaaattctaaatttgataaattatttcagatttttataatttggatacttttttcaggtgaatgaaagaatggtacctcgtgccgaattcttggcctcgagggccaa

SEQ ID NO: 55 - protein, 139 aa, Homo Sapiens
MPDIMRLITKDLSEPYSIYTYRYFIHNWPQLCFLAMVGEECVGAIVCKLDMHKKMFRRGYIAMLAVDSKYRRNGIGTNLVKKAIYAMVEGDCDEVVLETEITNKSALKLYENLGFVRDKRLFRYYLNGVDALRLKLWLR

SEQ ID NO: 56 - DNA, 417 bp, Homo Sapiens
  CDS (1)...(417)
atgcccgatatcatgagactgatcaccaaagatctgtccgaaccctactccatttatacctatagatattttatccacaactggccacagctgtgcttcttggccatggtaggggaggagtgtgtaggtgccatcgtttgcaagttggatatgcacaaaaagatgttccgcagaggttatatagccatgttagccgtggattccaaatacaggagaaatggcattggtactaacttggttaagaaagctatatatgccatggttgagggagactgtgatgaggttgttttggaaaccgaaataacaaataagtccgctttgaaactttatgaaaatcttggttttgttcgagataagaggctgttcagatactatttaaatggagttgatgcactgcgacttaaactgtggctgcgt

SEQ ID NO: 57 - protein, 87 aa, Homo Sapiens [sequence omitted]

SEQ ID NO: 58 - DNA, 804 bp, Homo Sapiens
  CDS (1)...(804)
aagcttgcggccgcctccctcccacgcgtccgcctgagcgtagcagaggtggccgcgaccacagccacccctgacggaggccccagagcgactgcaacaaaaggagccggggtacactcgggcgagaggccccctcactccctctctagtaatgcaagaactgcggtccccagcccggtggaggcagcggcggcgagcgatcccgcggcggcccgcaatggactggccgagggcaccgagcaggaggaggaggaggaagacgagcaggtgcggctgctgtcttcgtccctgaccgccgactgcagcttaagaagcccttcgggcagggaggttgagcctggggaggatcggacgatacgatatgtccgatatgaatccgagctacaaatgcccgatatcatgagactgatcaccaaagatctgtccgaaccctactccatttatacctatagatattttatccacaactggccacagctgtgcttcttggccatggtaggggaggagtgtgtaggtgccatcgtttgcaagttggatatgcacaaaaagatgttccgcagaggttatatagccatgttagccgtggattccaaatacaggagaaatggcattggtactaacttggttaagaaagctatatatgccatggttgagggagactgtgatgaggttgttttggaaaccgaaataacaaataagtccgctttgaaactttatgaaaatcttggttttgttcgagataagaggctgttcagatactatttaaatggagttgatgcactgcgacttaaactgtggctgcgt

SEQ ID NO: 59 - DNA, 1489 bp, Homo Sapiens
  CDS (58)...(1437)
aagtgtccggggtagccccgttacaggaatgtgtttctgatcatctgaatcttaatcatgtccaactgcctgcaaaatttcctgaaaattacaagcactcgtcttctatgttcaagattatgccaacagttaagaagtaaaaggaagtttttcggaactgtgccaatatccagattgcataggcgagttgtcattacaggcattggcttagtgactcctcttggtgttggaactcacctggtttgggatcgtcttatcggaggagagagtggaattgtttcactggttggtgaagagtataagagtatcccttgcagtgttgctgcttatgtgccaagaggtagtgatgaaggtcagttcaatgaacaaaactttgtgtccaaatcagatatcaagtccatgtcttctcccaccatcatggccattggggctgcagaattagccatgaaggattctggctggcatcctcagtcagaagctgatcaagtggctactggtgttgcaattggcatgggaatgattcctcttgaagttgtttctgaaactgctttgaattttcagacaaaaggttacaataaagttagcccattttttgtccctaagattctggtcaatatggcagcaggccaggtcagcattcgatataaactcaagggcccaaatcatgcagtatccacagcctgtaccacaggagctcatgctgtgggagactcatttagatttatagcccatggtgatgctgatgtgatggtggctggaggtacagattcttgtattagccctttatctcttgctgggttttccagagcccgggctctgagcacaaactcagatcccaagttggcatgtcgaccatttcatccaaagagagatggttttgtaatgggagaaggtgcagctgtgctggtgctggaagaatatgaacatgctgttcaaagaagagcccggatctatgcagaagttttgggctatggactctcaggtgatgctggtcacataactgcccctgatcctgaaggagaaggtgccttaaggtgtatggctgctgctttaaaagatgcaggtgtgcagcctgaggagatatcctatatcaatgcacatgctacttccacaccattgggagatgctgctgaaaacaaagctatcaaacatctcttcaaagaccatgcatatgcccttgcagtttcctcaactaagggagcaacaggacatctgctgggagctgcaggggcagtcgaggcagcttttaccacattagcttgttattatcaaaaactaccacctactttaaacctggattgttcggaaccagaatttgatctcaactatgttccactaaaggcacaggaatggaaaactgagaaaagatttattggcctcaccaattcctttggttttggtggtactaatgcaacactttgtattgctggactgtagaacatataatttgtaattaaatactgatttttaaatgttaaaaaaaaaaaaa

SEQ ID NO: 60 - protein, 459 aa, Homo Sapiens
MSNCLQNFLKITSTRLLCSRLCQQLRSKRKFFGTVPISRLHRRVVITGIGLVTPLGVGTHLVWDRLIGGESGIVSLVGEEYKSIPCSVAAYVPRGSDEGQFNEQNFVSKSDIKSMSSPTIMAIGAAELAMKDSGWHPQSEADQVATGVAIGMGMIPLEVVSETALNFQTKGYNKVSPFFVPKILVNMAAGQVSIRYKLKGPNHAVSTACTTGAHAVGDSFRFIAHGDADVMVAGGTDSCISPLSLAGFSRARALSTNSDPKLACRPFHPKRDGFVMGEGAAVLVLEEYEHAVQRRARIYAEVLGYGLSGDAGHITAPDPEGEGALRCMAAALKDAGVQPEEISYINAHATSTPLGDAAENKAIKHLFKDHAYALAVSSTKGATGHLLGAAGAVEAAFTTLACYYQKLPPTLNLDCSEPEFDLNYVPLKAQEWKTEKRFIGLTNSFGFGGTNATLCIAGL

SEQ ID NO: 61 - DNA, 1380 bp, Homo Sapiens
  CDS (1)...(1380)
atgtccaactgcctgcaaaatttcctgaaaattacaagcactcgtcttctatgttcaagattatgccaacagttaagaagtaaaaggaagtttttcggaactgtgccaatatccagattgcataggcgagttgtcattacaggcattggcttagtgactcctcttggtgttggaactcacctggtttgggatcgtcttatcggaggagagagtggaattgtttcactggttggtgaagagtataagagtatcccttgcagtgttgctgcttatgtgccaagaggtagtgatgaaggtcagttcaatgaacaaaactttgtgtccaaatcagatatcaagtccatgtcttctcccaccatcatggccattggggctgcagaattagccatgaaggattctggctggcatcctcagtcagaagctgatcaagtggctactggtgttgcaattggcatgggaatgattcctcttgaagttgtttctgaaactgctttgaattttcagacaaaaggttacaataaagttagcccattttttgtccctaagattctggtcaatatggcagcaggccaggtcagcattcgatataaactcaagggcccaaatcatgcagtatccacagcctgtaccacaggagctcatgctgtgggagactcatttagatttatagcccatggtgatgctgatgtgatggtggctggaggtacagattcttgtattagccctttatctcttgctgggttttccagagcccgggctctgagcacaaactcagatcccaagttggcatgtcgaccatttcatccaaagagagatggttttgtaatgggagaaggtgcagctgtgctggtgctggaagaatatgaacatgctgttcaaagaagagcccggatctatgcagaagttttgggctatggactctcaggtgatgctggtcacataactgcccctgatcctgaaggagaaggtgccttaaggtgtatggctgctgctttaaaagatgcaggtgtgcagcctgaggagatatcctatatcaatgcacatgctacttccacaccattgggagatgctgctgaaaacaaagctatcaaacatctcttcaaagaccatgcatatgcccttgcagtttcctcaactaagggagcaacaggacatctgctgggagctgcaggggcagtcgaggcagcttttaccacattagcttgttattatcaaaaactaccacctactttaaacctggattgttcggaaccagaatttgatctcaactatgttccactaaaggcacaggaatggaaaactgagaaaagatttattggcctcaccaattcctttggttttggtggtactaatgcaacactttgtattgctggactgtag

SEQ ID NO: 62 - protein, 458 aa, Artificial Sequence
  Pfam beta-ketoacyl synthase domain
IAIVGMSCRFPGAVNSPEEFWDLLREGRDAIREIPEDRGWDLDRLRDPDADNPGTSYSKYGGFLDDADRFDPQFQFGISPREAAAMDPQQRLFLETAWEALEDAGYTPKSLRGSKHAEKRDRVGVFVGVMSQEYGPDGAREEEDVEGYLVTGGNASVLAGRIAYTFGLEGPSISVDTACSSSLVAIHLACQSLRRGECDLALAGGVSVMLTPETYVEFDRQGALSPKYDDGEKRCKAFDAGADGFVLGEGVGAVVLKRLSDARADGDHIYAVIKGSAVNQDGASNGLSAPSGEAQARVIKKALEEAGVDPEDISYVEAHGTGTQLGDPIELAALLEVFGEDRDDKQPLALGSVKSNIGHTLAAAGVAGVIKVLLALKHGVLPPSLHIEELNPHNFPIDLESGPLYVLRETEEWERPVIDSAGKRVELPRRAGVSSFGASGTNAHLIIEEAKPRTARTA

SEQ ID NO: 63 - DNA, 2057 bp, Homo Sapiens
  CDS (172)...(1491)
tatagggagtcgacccacgcgtccggccaggggcaggtgcccgcccgcgtagacgcacccggcctgaccccgcgccaccatgtaaacggcgccagcaggcggacgctggcttctccgcctgggacccctccgccccgacccgggccccgcggccctcgatgaggacacaccatgctgaccggggtgaccgacggtatcttctgttgcctgctgggcacgccccccaacgccgtggggccactggagagcgtcgagtccagcgatggctacacctttgtagaggtcaagcccggccgcgtgctgcgggtgaagcatgcaggacccgccccagccgctgccccacctccaccatcatccgcatcctcggatgcagcccagggggacctctccggcttggtccgctgtcagcgccggatcaccgtgtaccgcaatgggcggttgctggtggaaaacctgggccgagcccctcgagccgacctcctacacgggcagaatggctctggggagccgccggccgccctggaggtggagctggcagatccggcgggcagcgatggccgcttggcccccggcagcgcaggcagcggcagcggcagtggcagtggtgggcggcggcggcgagccaggcgccccaagaggaccatccatattgactgtgagaagcgcatcactagctgcaaaggcgcccaggccgacgtggtgctctttttcatccatggtgtcggcggttccctggccatctggaaggagcagctggacttctttgtgcgcctaggctatgaggtggtggctcctgacctggccggccacggggccagctctgcgccccaggtggccgcagcctacaccttctatgcgctggctgaggacatgcgagcaatcttcaagcgctatgccaagaagcgaaatgtgctcattggccattcctacggtgtctctttctgcacattcctggcacatgagtacccagacctagtgcacaaggtgatcatgatcaatggcgggggccctacggcgctggagcccagcttctgctcaatcttcaacatgcccacctgcgtcctgcactgcttgtcgccctgcctggcctggagcttcctcaaggccggcttcgcccgccaaggagccaaggagaagcagctgttaaaggagggcaacgctttcaacgtgtcatccttcgtactccgggccatgatgagcggccagtactggcccgagggcgacgaggtctaccacgccgagctcaccgtgcccgtcctgcttgtccacggcatgcacgataagtttgtgccggtggaggaagaccagcgcatggccgagatcctgctcctggcattcctgaagctcatcgacgagggcagccacatggtgatgctggaatgccctgagacggtcaacacgctgctccacgaattcctgctctgggagcccgagccctcgcccaaggctctaccggagccactgccggcgcctccagaagacaagaagtagccgctgggccggcggggcatcgcttggtgagcacagccgcagcaggaggaggcccgagcctgcgccaggtctgcagcgcagaccacctgggcgggccgttcgctccggtgggcggggccaggtcagggagacgcccccaggctgcctgggcggggcgtggcatccgagggagcccagcggacattccgctctccgcttccgtcccgcggggcccatcggcgttttggggccgcagccgggaccctcacggaagatgaccttgtacagaagctctccctcaccttccccccaacgccacggccaaggcaggccccccaccccgctgtcttccgtgtcagccgtgcttgatcctgggacccacgagccccacagggaccctcgaggccccatcccgttatccgagacccttcctaccccccattcctcggcgctgggagctatttttgcccaagggggggggatgggggggctggcgccaccgaacctgcacatctcaacttgtaactcaataaacagaagtgacaatcggraaaaaaaaaaaaaaaaaaaaaaaaaaaaaaaaaaaa

SEQ ID NO: 64 - protein, 439 aa, Homo Sapiens
MLTGVTDGIFCCLLGTPPNAVGPLESVESSDGYTFVEVKPGRVLRVKHAGPAPAAAPPPPSSASSDAAQGDLSGLVRCQRRITVYRNGRLLVENLGRAPRADLLHGQNGSGEPPAALEVELADPAGSDGRLAPGSAGSGSGSGSGGRRRRARRPKRTIHIDCEKRITSCKGAQADVVLFFIHGVGGSLAIWKEQLDFFVRLGYEVVAPDLAGHGASSAPQVAAAYTFYALAEDMRAIFKRYAKKRNVLIGHSYGVSFCTFLAHEYPDLVHKVIMINGGGPTALEPSFCSIFNMPTCVLHCLSPCLAWSFLKAGFARQGAKEKQLLKEGNAFNVSSFVLRAMMSGQYWPEGDEVYHAELTVPVLLVHGMHDKFVPVEEDQRMAEILLLAFLKLIDEGSHMVMLECPETVNTLLHEFLLWEPEPSPKALPEPLPAPPEDKK

SEQ ID NO: 65 - DNA, 1320 bp, Homo Sapiens
  CDS (1)...(1320)
atgctgaccggggtgaccgacggtatcttctgttgcctgctgggcacgccccccaacgccgtggggccactggagagcgtcgagtccagcgatggctacacctttgtagaggtcaagcccggccgcgtgctgcgggtgaagcatgcaggacccgccccagccgctgccccacctccaccatcatccgcatcctcggatgcagcccagggggacctctccggcttggtccgctgtcagcgccggatcaccgtgtaccgcaatgggcggttgctggtggaaaacctgggccgagcccctcgagccgacctcctacacgggcagaatggctctggggagccgccggccgccctggaggtggagctggcagatccggcgggcagcgatggccgcttggcccccggcagcgcaggcagcggcagcggcagtggcagtggtgggcggcggcggcgagccaggcgccccaagaggaccatccatattgactgtgagaagcgcatcactagctgcaaaggcgcccaggccgacgtggtgctctttttcatccatggtgtcggcggttccctggccatctggaaggagcagctggacttctttgtgcgcctaggctatgaggtggtggctcctgacctggccggccacggggccagctctgcgccccaggtggccgcagcctacaccttctatgcgctggctgaggacatgcgagcaatcttcaagcgctatgccaagaagcgaaatgtgctcattggccattcctacggtgtctctttctgcacattcctggcacatgagtacccagacctagtgcacaaggtgatcatgatcaatggcgggggccctacggcgctggagcccagcttctgctcaatcttcaacatgcccacctgcgtcctgcactgcttgtcgccctgcctggcctggagcttcctcaaggccggcttcgcccgccaaggagccaaggagaagcagctgttaaaggagggcaacgctttcaacgtgtcatccttcgtactccgggccatgatgagcggccagtactggcccgagggcgacgaggtctaccacgccgagctcaccgtgcccgtcctgcttgtccacggcatgcacgataagtttgtgccggtggaggaagaccagcgcatggccgagatcctgctcctggcattcctgaagctcatcgacgagggcagccacatggtgatgctggaatgccctgagacggtcaacacgctgctccacgaattcctgctctgggagcccgagccctcgcccaaggctctaccggagccactgccggcgcctccagaagacaagaagtag

SEQ ID NO: 66 - DNA, 10172 bp, Homo Sapiens
  CDS (3687)...(9113)
  misc_feature (1)...(10172): n = A,T,C or G
gtattttattaagacagggtcaaaaacacatatactaatggtgaccatgatattggccaggtgtggtcactaaagaatggtgggcactggcatccagtggagaactcatgccccatctaacagtagaagatctagccatttgataccatgtaggaatgctcagtgttagcagattgtttcattattcaggagatgctggaacttcagatgtatatgtaaagctttcctgaatttaaacagggtatgtcagatgaaacaggtctgttgactgaatctggcccatggtcaattgatttgtgacctccctacattaggcacttgttggcacctttctattgcattataactgtcctgaaggcccgaggtggaaggggagatgcagaataaggcggagatggaacaatgagatgacaagagatgaaagacttcaagaaggatggatgattgcctatttcagagattctgcagagggcmamagaaatgggaataagmaaaggctattagattaaagtaaattaattatttggcacagcactacgtctacaggctgtgttctttaaagaaatgatcaaataacatgggaaatagttaagcaaattaaaatactttgtttactctgactctngtaattgtctttaatattctattatgcaatgtaaatctccaaaaggagaagagatttactgagattttttaaactttcatgatcaaggagtccctaggtcatacaatcccttgtagatagaatgttttgaggaaaacaccttggaaaagctggataagagactgaatgagtcactgggagtctatggaggcctgatgtggagactggaatgcacatggtagtgagcaaatgcacaatgagccagcgcagcagcttggcaagtaaagaaagtaggccaacctattaggaactaggaattgccagcttagtaatctttttaagacaaaaccattttagcattattcctttgctgaaaacaaaccagcgaaaacaaaaacaaaaacaaaacaaacaaaaaacaaaaaaaagcatcaaggggtgccctcctctgatgggtgaaatctccttgctttaacattccaggtctcctttatcaggccagctgacctttcttattccccagttgttccctggcctttctcattccccagttatttcctatgcttactccctgctctaaactccactggctgtccttattgcttgcatggtgagttgtctccccagctgctccagttagagaaatgcctgctttccaaggcacaggtcaaaccctgctttgcctattaagccttccttagccatcaagctaccagtcagttcttttccttacacaactggatcagttacttctgaaggacttgcatgggacttagtgtgttggagatggcctgtatgatttggagccaagagaataaaactatgtcttgagatctgcagctctctacccccatttgccctcacagtacacccaaatagggttaggataatattgcccagaaacacagaagagcaagggcataactccaatcacattgcatttcatagattgtggtctatagttatacaaccacctattattcattgagggtaaaggagtgtattctcttttatagacttgctcaacagtaaagagcatcatttctagacactaggctgagtatgttacatgtttatcatggtgaatcccagaatctccctaagaatagtgttattattcccattttacagaggagggagctgtcttgaaacattcaagtcagcttgttcacacttaatgaccagctctctatctggtgaaggtcgagtcaggtgtacctgacctcatgtacctgaccccaaacctgggctctttctgtcccagcacaccatctccatggccatgctggccactagaaatttaatgacagagaattaaaggtaagaatcacactgtgccttcaagtggcaaatatataccaccagacagaggaagacagataaaatctagttagggtctacacagtttgaatatcataggactcggtgcattctggggtatcataaggacctagcacagctcaagagaggccctcttgagtgagatttggaggatgcaacatcatgggggcacatgcctggcccgcagggcagtgagagtcttctactccctggccattcgtcagtgtcaccgaaggaggtgaccttcatttccaccctactctaagctcttggcttttctgtctcctttactagactgtgaactctgaggagagaaactattttatttatccagccctgtcatagtttctggtatataaacagtaactatttgttggtttgatgaatgaatgacaagtcagccaaggcaaggtgctcaaggtgacatgatagagacagcatgatagagacagcacctttattcccccatcagagagctggattacctcactgcatgttatgtgtctcctccgtttgtttatacactatccagaagtctctggcttctcagaatgcttgacaaattccaagtcctcccttcaataatgtcaaaccttataattttcaggcctcatcgaagattgtgaaatcctgcagcagcacaagaggtgtctgctgcccctcacactttccccacatcttccaacacactgccttgcacagagcagggtctatatacatgcacattgaatgactgcattgaaatagattggagacatggttaggaacctgtcctaacagtgcaatcttcttgagacaatgcttggtgaattcgggtgataaaaggagaagaaatcaggatagtgacagtgacatagatggggcaagaagagtgagcaggatctgtcaacttattggatatgggaggtgagggaggaggaagagaaaaaatgattcaaatactttgatctcagctgacagtttgaaggattatgcccaaaggggaaatagggaagttctctttccccatgaccctctcatcctcatttcagtttaagcatggagaaaagatttcccataaaagtcaggctgaaacactccatggagggagacagacctgggacagtcattcagtaatgtccaggaaaaccagaaggaaaggtttgccttcatctctctgcagaagagctttgctctgctgaggaggagaaatttgagctgaatgtatttctggttggtatgacttgtaagttctctgtttgatagcagagttgtttgaatgacctattttataactacacagagcttttccaaatagatggtgtctgtagaatgttcaggttaatgcatgagccgagtgctcagagtgtttgcacttggagcatctgagccttctttcttaataagtcatcttggcattttgtcaacaagttaatttgctttcctaagaaactagattaatacttcctgtactttgtgctattcacagatctacaatgcagtgagaagagaagaaacagaaaatacagttggatctctactccatttcctcaccaagctcccagcctccgagacagcccatggaaggataagcgttggtccatgcttaaagcaatgtgtccgagacactgtatgtgagtatcgcgccaccctccaaaggacttcaatatcgcagtacatcaccggttctctcctagaagcaaccacgtctttgggagcaagaagtggccttctcagtacttttggaggatccactggacgaatgatgctgaaagaacgccagccaggcccctctgtggccaattccaatgccctcccttcaagttcagctgggatcagcaaggagctgatcgatctgcagcctctcatccagttcccagaggaagtcgccagcatcctgatggagcaagagcagactatttacctcagggtcttgccagtcgactacctttgcttcttaacacgggacttgggcactcctgaatgccagagctccttgccctgcctcaaagcatccatctcagcgtcgattcttaccactcagaatggagagcacaatgcccttgaagatctggtgatgaggtttaatgaggtgagctcctgggtgacatggctgatcctcacggcaggctccatggaggagaagcgagaagtcttttcatatttggtgcatgtggccaaatgctgctggaacatgggcaactacaacgctgtcatggagttcttggctggcctcaggtcaagaaaagttttaaaaatgtggcagttcatggaccagtctgatattgagaccatgaggagcctgaaggatgctatggcccagcatgagtcctcttgtgagtacagaaaggtggtgacacgtgccctgcacatccctggctgtaaggtggttcaagggtgtggggtgtttctgaaggagctctgtgaagtgcttgacggcgcctccggtctcatgaagctttgcccgcggtccaattcccaagaagaaactttagagtttgtagcagattacagtggacaagataatttcttacaacgagtgggacaaaatggcttaaagaattcggagaaggagtccactgtcaacagcatctttcaggtcatccggagctgcaatcgaagtctggagacagacgaggaggacagccccagtgaaggaaacagctccaggaaaagctccttgaaggataaaagccgatggcagtttataattggagatttgttggattcagacaatgacatctttgagcaatccaaagaatacgactctcatggttcagaggactcacagaaggccttcgaccatgggacggagctcatcccttggtacgtgctgtccatccaagccgatgtgcaccagttcctgctgcagggggccacggtcatccactacgaccaggacacacacctctctgcccgctgcttcctccagcttcagcccgacaatagcaccttgacctgggtaaagcccacaactgcctccccagccagcagtaaagcaaaacttggtgtacttaataacacagctgagcctggaaaattcccactactgggtaatgctggattaagtagcctgacggaaggggtcttggatctttttgcagtgaaggctgtatacatgggccaccctggcattgatatacacactgtgtgtgttcagaacaaactgggtagcatgttcctgtcagagactggtgtgacattgctctatgggcttcagaccacagacaacagattattgcacttcgtggcaccaaagcacacagctaaaatgctcttcagcggattattggaactcactagagctgtgagaaagatgaggaaattccctgaccaaagacagcagtggctgcggaaacagtacgtcagcctttatcaggaggatggacggtatgaaggcccaactttggctcacgctgtggagttgtttggtggcagacggtggagtgctcgaaaccccagccccggaacatcagcaaagaatgctgagaagcccaatatgcagagaaacaataccctgggcataagcactaccaagaaaaagaagaaaatcctcatgaggggtgagagtggagaggtaactgacgatgagatggcaacccgaaaggccaagatgcacaaagagtgtcgaagccggagtggttctgatcctcaagacattaatgaacaagaagaatcagaggtgaatgccatcgctaaccctccaaaccccctcccttccagaagagcccactctttgaccacagctgggtcccccaacttggctgccgggacgtcatctcccatcaggccagtgtcctcccctgtgctgtcttcttcaaacaagagcccatccagtgcttggagcagtagtagctggcacgggcggatcaaaggcggcatgaagggatttcagagcttcatggtttcagatagcaacatgagttttgttgaatttgttgagctgttcaaatcattcagtgtcaggagccgcaaggacctgaaggatctgtttgatgtctatgcagtgccctgcaaccgatctggctccgagtcagccccactctacaccaacctgacaattgatgaaaacaccagcgatcttcagcctgacctagatctgttgaccagaaatgtctcggatttggggttgttcattaagagtaaacagcagctatcggacaaccagaggcagatatctgatgccattgctgctgcaagcattgtgacaaatggcactgggattgagagcacatctctgggcatttttggggtgggcatacttcagctcaacgatttcctcgtgaattgccaaggagaacactgcacttatgatgaaatcctcagcatcatccagaagttcgagcctagcatcagtatgtgtcatcagggactaatgtcatttgaagggtttgccaggtttctgatggataaagaaaattttgcctcaaaaaatgatgagtcacaggagaacattaaagaactgcagctacccctctcatactattacatcgaatcttcgcacaatacctacctcacgggccatcagctcaaaggagaatcctcggtagaactctacagccaggtccttttgcaaggctgtcgaagtgtagaattggactgctgggacggagacgatgggatgcccatcatttatcatggacatacgctgacaaccaagatccccttcaaggaagtggttgaagccattgatcgcagtgccttcatcaactctgacctgccaatcatcatatcgattgagaaccactgttcattgcctcagcaacgaaaaatggcagaaattttcaagactgtgtttggagaaaagctggtgactaaattcttatttgagactgatttctcagatgatccaatgcttccttcacctgaccaactcagaaagaaagttcttcttaaaaacaagaagctaaaagcccatcagacgccagtggatatcttaaagcaaaaggctcatcagttagcatctatgcaagtgcaggcttataatggtgggaatgccaacccccgacctgccaataatgaggaagaggaagatgaggaggacgaatatgattatgactatgaatccctttctgatgacaacattctggaagacagacctgaaaataaatcatgtaatgacaagcttcagtttgaatataatgaagaaatcccaaagaggataaagaaagcagataactctgcttgcaacaaaggaaaggtttatgatatggaactgggagaagaattttatcttgatcagaataaaaaggaaagcagacagattgcaccagagctttctgaccttgtaatctattgtcaagcagtaaaatttccaggactgtcaactctaaatgcatctggctctagcagaggaaaagaaaggaaaagcaggaagtccatttttggcaacaatccgggcagaatgagcccaggggagacagcatcatttaacaaaacatctggaaaaagttcctgtgaaggcattcgacagacctgggaggaatcttcttcccctctcaacccaaccacgtccctcagtgctatcattagaactcccaaatgttatcatatctcgtcgctgaatgaaaatgccgccaaacgtctgtgtcgcaggtattctcagaaactgacccagcacaccgcctgtcagctgctgagaacttaccctgctgccacccgcatcgactcttccaacccgaaccccctcatgttctggctccatgggatacagcttgtggcactcaactaccagactgatgatctccctttacatttaaatgctgcaatgtttgaggcaaatggtggttgtggttatgtattgaaacctccagttctgtgggacaagaactgccccatgtatcagaagttttctccactagaaagagatctggacagcatggatcctgcagtctattctttaactattgtctctggtcagaatgtgtgccccagtaatagcatgggaagcccgtgcattgaagtcgacgtcctgggcatgcctctggacagctgccatttccgcacaaagcccatccatcgaaacaccctgaaccccatgtggaacgagcagtttctgttccacgttcacttcgaagatcttgtatttcttcgttttgcagttgtggaaaacaatagttcagcggtaactgctcagagaatcattccactgaaagctttaaaacgaggatatcgacatcttcagctgcgaaaccttcacaatgaagtcttggagatttctagtttattcattaacagcagaaggatggaagaaaattcctctggcaataccatgtcagcctcttcgatgtttaatacagaagaaagaaaatgtttgcagactcacagagtcacggtgcatggggtcccagggccagagccctttaccgttttcactattaatggaggcaccaaggcaaagcagcttctgcagcaaattctgacaaatgaacaagacatcaaacctgttaccacagactattttttgatggaagaaaaatattttatatctaaagaaaagaatgaatgtaggaaacaaccattccagagagccattggtccagaagaggagatcatgcaaattttaagcagctggtttccagaagagggatacatgggcaggattgtcttaaaaacccagcaggaaaacctagaagagaaaaacattgttcaagatgacaaagaggtgatcttgagctcagaggaggagagtttctttgtccaagtgcatgatgtttctccagagcaacctcgaacagtcatcaaagcaccccgcgtcagcactgcacaggatgtcattcagcagaccttatgcaaagccaaatattcctacagcatcctgagcaaccccaatccaagcgactatgtgcttttggaagaggtggtgaaagacactaccaacaagaagactaccacaccaaagtcctctcagcgggtccttctggatcaggagtgtgtgtttcaagcccaaagcaagtggaaaggtgcaggaaaattcatccttaagctaaaggagcaggtgcaggcatctcgagaagataaaaagaaaggcatttctttcgcaagtgaactcaagaagctcaccaagtcaactaaacagccccgaggacttacatcaccttctcagctcttgacctcagaaagtatccaaaccaaggaggagaaacctgtgggtggcttgtcctccagtgacacaatggattaccgacagtgactaagggcagcatgtttaacccaggtgaagatctttaagcaagaagttaaagagtgaacatggtggaaaaaatataattattttcatcagacttaaactggaaattgatgatttctgaactgaagccttcacacatgtgagatccatgctgaggagaagcaaaatggcacagggctagttgccaccaaccaatttactgatgaatgaagcccaggggactgccattttataaatgtcagcagttggaaaaatcgtcacgaattgacttagagcaagggtcagcaagcttgtctgtaaagggccaaacagtaaatattttagggctgggggccataaaatatgttgcaaccacccaattctgccattgtagtgcaaaagcagccatagacaacacatacatgaacgaacgtggctgtattccaataaaactttatttatggacactgaaaaaaaaaaaaaaaagggcggccgctcgagtctagagggcmcrtwwaaacccgctsathccccyccacgwgcygcmtwcawadaatgcagccatytgttgtttkcccytcyyccgtgccttccttgaycctgrmaartgaagcactcccacwgwaatttcacwaataaaatgwkkaawtygcatcgttctrgtttgrgtaggtchcawtytattcttgkgkcttatcatgtctggartccccgggtaccgagctcgaattaattcctcttccgcttcctcygctcactgactcgctgcgctcggtcgttcggctgcggcgagcggtatcagctcactcaaaggcggtaatacggttawtccacagaatcaggggartaacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagatacccaggcgtttccccctggaagctccctcgtgcgctctcctgttccgaccctgccgcttaccggatacctg

SEQ ID NO: 67 - protein, 1809 aa, Homo Sapiens
MMLKERQPGPSVANSNALPSSSAGISKELIDLQPLIQFPEEVASILMEQEQTIYLRVLPVDYLCFLTRDLGTPECQSSLPCLKASISASILTTQNGEHNALEDLVMRFNEVSSWVTWLILTAGSMEEKREVFSYLVHVAKCCWNMGNYNAVMEFLAGLRSRKVLKMWQFMDQSDIETMRSLKDAMAQHESSCEYRKVVTRALHIPGCKVVQGCGVFLKELCEVLDGASGLMKLCPRSNSQEETLEFVADYSGQDNFLQRVGQNGLKNSEKESTVNSIFQVIRSCNRSLETDEEDSPSEGNSSRKSSLKDKSRWQFIIGDLLDSDNDIFEQSKEYDSHGSEDSQKAFDHGTELIPWYVLSIQADVHQFLLQGATVIHYDQDTHLSARCFLQLQPDNSTLTWVKPTTASPASSKAKLGVLNNTAEPGKFPLLGNAGLSSLTEGVLDLFAVKAVYMGHPGIDIHTVCVQNKLGSMFLSETGVTLLYGLQTTDNRLLHFVAPKHTAKMLFSGLLELTRAVRKMRKFPDQRQQWLRKQYVSLYQEDGRYEGPTLAHAVELFGGRRWSARNPSPGTSAKNAEKPNMQRNNTLGISTTKKKKKILMRGESGEVTDDEMATRKAKMHKECRSRSGSDPQDINEQEESEVNAIANPPNPLPSRRAHSLTTAGSPNLAAGTSSPIRPVSSPVLSSSNKSPSSAWSSSSWHGRIKGGMKGFQSFMVSDSNMSFVEFVELFKSFSVRSRKDLKDLFDVYAVPCNRSGSESAPLYTNLTIDENTSDLQPDLDLLTRNVSDLGLFIKSKQQLSDNQRQISDAIAAASIVTNGTGIESTSLGIFGVGILQLNDFLVNCQGEHCTYDEILSIIQKFEPSISMCHQGLMSFEGFARFLMDKENFASKNDESQENIKELQLPLSYYYIESSHNTYLTGHQLKGESSVELYSQVLLQGCRSVELDCWDGDDGMPIIYHGHTLTTKIPFKEVVEAIDRSAFINSDLPIIISIENHCSLPQQRKMAEIFKTVFGEKLVTKFLFETDFSDDPMLPSPDQLRKKVLLKNKKLKAHQTPVDILKQKAHQLASMQVQAYNGGNANPRPANNEEEEDEEDEYDYDYESLSDDNILEDRPENKSCNDKLQFEYNEEIPKRIKKADNSACNKGKVYDMELGEEFYLDQNKKESRQIAPELSDLVIYCQAVKFPGLSTLNASGSSRGKERKSRKSIFGNNPGRMSPGETASFNKTSGKSSCEGIRQTWEESSSPLNPTTSLSAIIRTPKCYHISSLNENAAKRLCRRYSQKLTQHTACQLLRTYPAATRIDSSNPNPLMFWLHGIQLVALNYQTDDLPLHLNAAMFEANGGCGYVLKPPVLWDKNCPMYQKFSPLERDLDSMDPAVYSLTIVSGQNVCPSNSMGSPCIEVDVLGMPLDSCHFRTKPIHRNTLNPMWNEQFLFHVHFEDLVFLRFAVVENNSSAVTAQRIIPLKALKRGYRHLQLRNLHNEVLEISSLFINSRRMEENSSGNTMSASSMFNTEERKCLQTHRVTVHGVPGPEPFTVFTINGGTKAKQLLQQILTNEQDIKPVTTDYFLMEEKYFISKEKNECRKQPFQRAIGPEEEIMQILSSWFPEEGYMGRIVLKTQQENLEEKNIVQDDKEVILSSEEESFFVQVHDVSPEQPRTVIKAPRVSTAQDVIQQTLCKAKYSYSILSNPNPSDYVLLEEVVKDTTNKKTTTPKSSQRVLLDQECVFQAQSKWKGAGKFILKLKEQVQASREDKKKGISFASELKKLTKSTKQPRGLTSPSQLLTSESIQTKEEKPVGGLSSSDTMDYRQ

SEQ ID NO: 68 - DNA, 5430 bp, Homo Sapiens
  CDS (1)...(5430)
atgatgctgaaagaacgccagccaggcccctctgtggccaattccaatgccctcccttcaagttcagctgggatcagcaaggagctgatcgatctgcagcctctcatccagttcccagaggaagtcgccagcatcctgatggagcaagagcagactatttacctcagggtcttgccagtcgactacctttgcttcttaacacgggacttgggcactcctgaatgccagagctccttgccctgcctcaaagcatccatctcagcgtcgattcttaccactcagaatggagagcacaatgcccttgaagatctggtgatgaggtttaatgaggtgagctcctgggtgacatggctgatcctcacggcaggctccatggaggagaagcgagaagtcttttcatatttggtgcatgtggccaaatgctgctggaacatgggcaactacaacgctgtcatggagttcttggctggcctcaggtcaagaaaagttttaaaaatgtggcagttcatggaccagtctgatattgagaccatgaggagcctgaaggatgctatggcccagcatgagtcctcttgtgagtacagaaaggtggtgacacgtgccctgcacatccctggctgtaaggtggttcaagggtgtggggtgtttctgaaggagctctgtgaagtgcttgacggcgcctccggtctcatgaagctttgcccgcggtccaattcccaagaagaaactttagagtttgtagcagattacagtggacaagataatttcttacaacgagtgggacaaaatggcttaaagaattcggagaaggagtccactgtcaacagcatctttcaggtcatccggagctgcaatcgaagtctggagacagacgaggaggacagccccagtgaaggaaacagctccaggaaaagctccttgaaggataaaagccgatggcagtttataattggagatttgttggattcagacaatgacatctttgagcaatccaaagaatacgactctcatggttcagaggactcacagaaggccttcgaccatgggacggagctcatcccttggtacgtgctgtccatccaagccgatgtgcaccagttcctgctgcagggggccacggtcatccactacgaccaggacacacacctctctgcccgctgcttcctccagcttcagcccgacaatagcaccttgacctgggtaaagcccacaactgcctccccagccagcagtaaagcaaaacttggtgtacttaataacacagctgagcctggaaaattcccactactgggtaatgctggattaagtagcctgacggaaggggtcttggatctttttgcagtgaaggctgtatacatgggccaccctggcattgatatacacactgtgtgtgttcagaacaaactgggtagcatgttcctgtcagagactggtgtgacattgctctatgggcttcagaccacagacaacagattattgcacttcgtggcaccaaagcacacagctaaaatgctcttcagcggattattggaactcactagagctgtgagaaagatgaggaaattccctgaccaaagacagcagtggctgcggaaacagtacgtcagcctttatcaggaggatggacggtatgaaggcccaactttggctcacgctgtggagttgtttggtggcagacggtggagtgctcgaaaccccagccccggaacatcagcaaagaatgctgagaagcccaatatgcagagaaacaataccctgggcataagcactaccaagaaaaagaagaaaatcctcatgaggggtgagagtggagaggtaactgacgatgagatggcaacccgaaaggccaagatgcacaaagagtgtcgaagccggagtggttctgatcctcaagacattaatgaacaagaagaatcagaggtgaatgccatcgctaaccctccaaaccccctcccttccagaagagcccactctttgaccacagctgggtcccccaacttggctgccgggacgtcatctcccatcaggccagtgtcctcccctgtgctgtcttcttcaaacaagagcccatccagtgcttggagcagtagtagctggcacgggcggatcaaaggcggcatgaagggatttcagagcttcatggtttcagatagcaacatgagttttgttgaatttgttgagctgttcaaatcattcagtgtcaggagccgcaaggacctgaaggatctgtttgatgtctatgcagtgccctgcaaccgatctggctccgagtcagccccactctacaccaacctgacaattgatgaaaacaccagcgatcttcagcctgacctagatctgttgaccagaaatgtctcggatttggggttgttcattaagagtaaacagcagctatcggacaaccagaggcagatatctgatgccattgctgctgcaagcattgtgacaaatggcactgggattgagagcacatctctgggcatttttggggtgggcatacttcagctcaacgatttcctcgtgaattgccaaggagaacactgcacttatgatgaaatcctcagcatcatccagaagttcgagcctagcatcagtatgtgtcatcagggactaatgtcatttgaagggtttgccaggtttctgatggataaagaaaattttgcctcaaaaaatgatgagtcacaggagaacattaaagaactgcagctacccctctcatactattacatcgaatcttcgcacaatacctacctcacgggccatcagctcaaaggagaatcctcggtagaactctacagccaggtccttttgcaaggctgtcgaagtgtagaattggactgctgggacggagacgatgggatgcccatcatttatcatggacatacgctgacaaccaagatccccttcaaggaagtggttgaagccattgatcgcagtgccttcatcaactctgacctgccaatcatcatatcgattgagaaccactgttcattgcctcagcaacgaaaaatggcagaaattttcaagactgtgtttggagaaaagctggtgactaaattcttatttgagactgatttctcagatgatccaatgcttccttcacctgaccaactcagaaagaaagttcttcttaaaaacaagaagctaaaagcccatcagacgccagtggatatcttaaagcaaaaggctcatcagttagcatctatgcaagtgcaggcttataatggtgggaatgccaacccccgacctgccaataatgaggaagaggaagatgaggaggacgaatatgattatgactatgaatccctttctgatgacaacattctggaagacagacctgaaaataaatcatgtaatgacaagcttcagtttgaatataatgaagaaatcccaaagaggataaagaaagcagataactctgcttgcaacaaaggaaaggtttatgatatggaactgggagaagaattttatcttgatcagaataaaaaggaaagcagacagattgcaccagagctttctgaccttgtaatctattgtcaagcagtaaaatttccaggactgtcaactctaaatgcatctggctctagcagaggaaaagaaaggaaaagcaggaagtccatttttggcaacaatccgggcagaatgagcccaggggagacagcatcatttaacaaaacatctggaaaaagttcctgtgaaggcattcgacagacctgggaggaatcttcttcccctctcaacccaaccacgtccctcagtgctatcattagaactcccaaatgttatcatatctcgtcgctgaatgaaaatgccgccaaacgtctgtgtcgcaggtattctcagaaactgacccagcacaccgcctgtcagctgctgagaacttaccctgctgccacccgcatcgactcttccaacccgaaccccctcatgttctggctccatgggatacagcttgtggcactcaactaccagactgatgatctccctttacatttaaatgctgcaatgtttgaggcaaatggtggttgtggttatgtattgaaacctccagttctgtgggacaagaactgccccatgtatcagaagttttctccactagaaagagatctggacagcatggatcctgcagtctattctttaactattgtctctggtcagaatgtgtgccccagtaatagcatgggaagcccgtgcattgaagtcgacgtcctgggcatgcctctggacagctgccatttccgcacaaagcccatccatcgaaacaccctgaaccccatgtggaacgagcagtttctgttccacgttcacttcgaagatcttgtatttcttcgttttgcagttgtggaaaacaatagttcagcggtaactgctcagagaatcattccactgaaagctttaaaacgaggatatcgacatcttcagctgcgaaaccttcacaatgaagtcttggagatttctagtttattcattaacagcagaaggatggaagaaaattcctctggcaataccatgtcagcctcttcgatgtttaatacagaagaaagaaaatgtttgcagactcacagagtcacggtgcatggggtcccagggccagagccctttaccgttttcactattaatggaggcaccaaggcaaagcagcttctgcagcaaattctgacaaatgaacaagacatcaaacctgttaccacagactattttttgatggaagaaaaatattttatatctaaagaaaagaatgaatgtaggaaacaaccattccagagagccattggtccagaagaggagatcatgcaaattttaagcagctggtttccagaagagggatacatgggcaggattgtcttaaaaacccagcaggaaaacctagaagagaaaaacattgttcaagatgacaaagaggtgatcttgagctcagaggaggagagtttctttgtccaagtgcatgatgtttctccagagcaacctcgaacagtcatcaaagcaccccgcgtcagcactgcacaggatgtcattcagcagaccttatgcaaagccaaatattcctacagcatcctgagcaaccccaatccaagcgactatgtgcttttggaagaggtggtgaaagacactaccaacaagaagactaccacaccaaagtcctctcagcgggtccttctggatcaggagtgtgtgtttcaagcccaaagcaagtggaaaggtgcaggaaaattcatccttaagctaaaggagcaggtgcaggcatctcgagaagataaaaagaaaggcatttctttcgcaagtgaactcaagaagctcaccaagtcaactaaacagccccgaggacttacatcaccttctcagctcttgacctcagaaagtatccaaaccaaggaggagaaacctgtgggtggcttgtcctccagtgacacaatggattaccgacagtga

SEQ ID NO: 69 - protein, 261 aa, Artificial Sequence
  Consensus amino acid sequence
LLLLDPEELAEQLTLLDFELFRKIEPSELLGSVWGKRSKKSPSPLAPQNLEAFIERFNEVSNWVATEILKQTTLKPKKRAEVLSKFIKVAKHCRELNNFNSLMAIVSALSSSPISRLKKTWEKLSSKYKKLFEELEELLDPSERNFKNYREALKSCNKSPNVQPPCVPFLGVYLKDLTFIDEGNPDFLENGTKGLVNFEKRRKIAKILREIRQLQSACQPYNLKPNRNDIQELLRASRPLEVLPEEEDELYELSLRIEPRV

SEQ ID NO: 70 - protein, 153 aa, Artificial Sequence
  Consensus amino acid sequence
DMSIPLSHYFISSSHNTYLTGKQLWGKSSVESYRQQLDAGCRCVELDCWDGKPDDEPIIYHGHTLTLEIKLKDVLEAIKDFAFKPTSPYPVILSLENHCNSDDQQRKMAKYFKEIFGDMLLTKPTLDSLTTEPGLPLPSLKDLRGKILLKNKK

SEQ ID NO: 71 - protein, 14 aa, Artificial Sequence
  Consensus amino acid sequence
ELSNLVNYIQSIKF

SEQ ID NO: 72 - protein, 102 aa, Artificial Sequence
  Consensus amino acid sequence
SYEISSFSERKVKAKKLLKESPVEFVKYNKRQLSRVYPKGTRVDSSNFMPQVFWNAGCQMVALNFQTSDLPMQINDGMFEYNGGQPDGSFKSGYLLKPEFLR

SEQ ID NO: 73 - protein, 95 aa, Artificial Sequence
  Consensus amino acid sequence
LTVTVIEARNLPKMDKVNGRLSDPYVKVSLLGDKKDLKKFKTKVVKKTNGLNPVWNEETFVFEKVPLPELASKTLRFAVYDEDRFSRDDFIGQVT

SEQ ID NO: 74 - protein, 113 aa, Artificial Sequence
  Consensus amino acid sequence
DQGVLRVYFQDLLSVTPGVAYKTIRVSSEDTAPDVIQEALEKFRLDDRMEDPEEYALVEVLLTREGALESGGKERKLPDDENPLQLRLNLPRDDRRSVRQQSSLRFLLKRRDD

SEQ ID NO: 75 - DNA, 2379 bp, Homo Sapiens
  CDS (225)...(2303)
ccgcggagtctcactctgctgcctaggctgagtgcagtggtgtgatcgaggcgcactgcagccttggcctcctgggctcaagcgatcctcacctcggcctaccgagtagctgggactacaggcacgcgccactacactcggatttctgacagtcagacttgtccacaagaactcaactggcaaggctgcttttctgtgctaaaactggggagctagtgggcaccatgaagatcttctgcagtcgggccaatccgaccacggggtctgtggagtggctggaggaggatgaacactatgattaccaccaggagattgcaaggtcatcttatgcagatatgctacatgacaaagacagaaatgtaaaatactaccaaggtatccgggctgccgtgagcagggtgaaggacagaggacagaaggccttggttctcgacattggcactggcacgggactcttgtcaatgatggcggtcacagcaggtgccgacttctgctatgccatcgaggttttcaagcctatggctgatgctgctgtgaagattgtggagaaaaatggctttagtgataagattaaggttatcaacaagcattccaccgaggtgactgtaggtccagagggtgacatgccatgccgtgccaacatcctggtcacagagttgtttgacacagagctgatcggggagggggcgctgccctcctatgagcacgcacacaggcatctcgtggaggaaaattgtgaggccgtgccccacagagccaccgtctatgcacagctggtggagtccgggaggatgtggtcgtggaacaagctatttcccatccacgtgcagaccagcctcggagagcaggtcatcgtccctcccgttgacgtggagagctgccctggcgcaccctctgtctgtgacattcagctgaaccaggtgtcaccagccgactttacagtcctcagcgatgtgctgcccatgttcagcatagacttcagcaagcaagtcagtagctcagcagcctgccatagcaggcggtttgaacctctgacatctggccgagctcaggtggttctctcgtggtgggacattgaaatggaccctgaggggaagatcaagtgcaccatggcccccttctgggcacactcagacccagaggagatgcagtggcgggaccactggatgcagtgtgtgtacttcctgccacaagaggagcctgtggtgcagggctcagcgctctatctggtagcccaccacgatgactactgcgtatggtacagcctgcagaggaccagccctgaaaagaatgagagagtccgccagatgcgccccgtgtgtgactgccaggctcacctgctctggaaccggcctcggtttggagagatcaatgaccaggacagaactgatcgatacgtccaggctctgaggaccgtgctgaagccagacagcgtgtgcctgtgtgtcagcgatggcagcctgctctccgtgctggcccatcacctgggggtggagcaggtgtttacagtcgagagttcagcagcttctcacaaactgttgagaaaaatcttcaaggctaaccacttggaagataaaattaacatcatagagaaacggccggaattattaacaaatgaggacctacagggcagaaaggtctctctcctcctgggcgagccgttcttcactaccagcctgctgccgtggcacaacctctacttctggtacgtgcggaccgctgtggaccagcacctggggccaggtgccatggtgatgccccaggcagcctcgctgcacgctgtggttgtggagttcagggacctgtggcggatccggagcccctgtggtgactgcgaaggcttcgacgtgcacatcatggacgacatgattaagcgtgccctggacttcagggagagcagggaagctgagccccacccgctgtgggagtacccatgccgcagcctctccgagccctggcagatcctgacctttgacttccagcagccggtgcccctgcagcccctgtgtgccgagggcactgtggagctcagaaggcccgggcagagccacgcagcggtgctatggatggagtaccacctgaccccggagtgcacgctcagcactggcctcctggagcctgcagaccccgaggggggctgctgctggaacccccactgcaagcaggccgtctacttcttcagccctgccccagatcccagagcactgctgggtggcccacggactgtcagctatgcagtggagtttcaccccgacacaggcgacatcatcatggagttcaggcatgcagataccccagactgaccactcttgagcaataaagtggcctgagggctgggaaaaaaaaaaaaaaaaaaaaaaaaaaaaaaaaagggcgaaa

SEQ ID NO: 76 - protein, 692 aa, Homo Sapiens
MKIFCSRANPTTGSVEWLEEDEHYDYHQEIARSSYADMLHDKDRNVKYYQGIRAAVSRVKDRGQKALVLDIGTGTGLLSMMAVTAGADFCYAIEVFKPMADAAVKIVEKNGFSDKIKVINKHSTEVTVGPEGDMPCRANILVTELFDTELIGEGALPSYEHAHRHLVEENCEAVPHRATVYAQLVESGRMWSWNKLFPIHVQTSLGEQVIVPPVDVESCPGAPSVCDIQLNQVSPADFTVLSDVLPMFSIDFSKQVSSSAACHSRRFEPLTSGRAQVVLSWWDIEMDPEGKIKCTMAPFWAHSDPEEMQWRDHWMQCVYFLPQEEPVVQGSALYLVAHHDDYCVWYSLQRTSPEKNERVRQMRPVCDCQAHLLWNRPRFGEINDQDRTDRYVQALRTVLKPDSVCLCVSDGSLLSVLAHHLGVEQVFTVESSAASHKLLRKIFKANHLEDKINIIEKRPELLTNEDLQGRKVSLLLGEPFFTTSLLPWHNLYFWYVRTAVDQHLGPGAMVMPQAASLHAVVVEFRDLWRIRSPCGDCEGFDVHIMDDMIKRALDFRESREAEPHPLWEYPCRSLSEPWQILTFDFQQPVPLQPLCAEGTVELRRPGQSHAAVLWMEYHLTPECTLSTGLLEPADPEGGCCWNPHCKQAVYFFSPAPDPRALLGGPRTVSYAVEFHPDTGDIIMEFRHADTPD

SEQ ID NO: 77 - DNA, 2079 bp, Homo Sapiens
  CDS (1)...(2079)
atgaagatcttctgcagtcgggccaatccgaccacggggtctgtggagtggctggaggaggatgaacactatgattaccaccaggagattgcaaggtcatcttatgcagatatgctacatgacaaagacagaaatgtaaaatactaccaaggtatccgggctgccgtgagcagggtgaaggacagaggacagaaggccttggttctcgacattggcactggcacgggactcttgtcaatgatggcggtcacagcaggtgccgacttctgctatgccatcgaggttttcaagcctatggctgatgctgctgtgaagattgtggagaaaaatggctttagtgataagattaaggttatcaacaagcattccaccgaggtgactgtaggtccagagggtgacatgccatgccgtgccaacatcctggtcacagagttgtttgacacagagctgatcggggagggggcgctgccctcctatgagcacgcacacaggcatctcgtggaggaaaattgtgaggccgtgccccacagagccaccgtctatgcacagctggtggagtccgggaggatgtggtcgtggaacaagctatttcccatccacgtgcagaccagcctcggagagcaggtcatcgtccctcccgttgacgtggagagctgccctggcgcaccctctgtctgtgacattcagctgaaccaggtgtcaccagccgactttacagtcctcagcgatgtgctgcccatgttcagcatagacttcagcaagcaagtcagtagctcagcagcctgccatagcaggcggtttgaacctctgacatctggccgagctcaggtggttctctcgtggtgggacattgaaatggaccctgaggggaagatcaagtgcaccatggcccccttctgggcacactcagacccagaggagatgcagtggcgggaccactggatgcagtgtgtgtacttcctgccacaagaggagcctgtggtgcagggctcagcgctctatctggtagcccaccacgatgactactgcgtatggtacagcctgcagaggaccagccctgaaaagaatgagagagtccgccagatgcgccccgtgtgtgactgccaggctcacctgctctggaaccggcctcggtttggagagatcaatgaccaggacagaactgatcgatacgtccaggctctgaggaccgtgctgaagccagacagcgtgtgcctgtgtgtcagcgatggcagcctgctctccgtgctggcccatcacctgggggtggagcaggtgtttacagtcgagagttcagcagcttctcacaaactgttgagaaaaatcttcaaggctaaccacttggaagataaaattaacatcatagagaaacggccggaattattaacaaatgaggacctacagggcagaaaggtctctctcctcctgggcgagccgttcttcactaccagcctgctgccgtggcacaacctctacttctggtacgtgcggaccgctgtggaccagcacctggggccaggtgccatggtgatgccccaggcagcctcgctgcacgctgtggttgtggagttcagggacctgtggcggatccggagcccctgtggtgactgcgaaggcttcgacgtgcacatcatggacgacatgattaagcgtgccctggacttcagggagagcagggaagctgagccccacccgctgtgggagtacccatgccgcagcctctccgagccctggcagatcctgacctttgacttccagcagccggtgcccctgcagcccctgtgtgccgagggcactgtggagctcagaaggcccgggcagagccacgcagcggtgctatggatggagtaccacctgaccccggagtgcacgctcagcactggcctcctggagcctgcagaccccgaggggggctgctgctggaacccccactgcaagcaggccgtctacttcttcagccctgccccagatcccagagcactgctgggtggcccacggactgtcagctatgcagtggagtttcaccccgacacaggcgacatcatcatggagttcaggcatgcagataccccagactga

SEQ ID NO: 78 - protein, 296 aa, Artificial Sequence
  Consensus amino acid sequence
RVFQLRQDPLTGNSEWIVIEDNDQPGTSTDGLLATTSYLDMLNDSRRNIAYRLAIEKTITEPCHVLDIGFVFSLNFDKGECGICVYSAGTGLLSMMAVRAMRGDSKGMVTACESYLPMVKLMRKVMHKNGMTKNINLINKRSDELKVGSEDIASRADVLKEITISLIPSLQHAHDMLLVDNPKTVPYRATTYCQLVESTFLCNLQDLRNNEAKTSDGVRLVPPGLESLFGIKSQQYSMHVDAIIKEIKLDSEGTIFYSTAPRWIDSNSEIEESLFPPVAVHSAPLRSNRLLITESF

SEQ ID NO: 79 - DNA, 3624 bp, Homo Sapiens
  CDS (339)...(1361)
tagtctaactcgcggctgtcaccgccactgcagcggagccggccggccgggcgctgcgggacgggcgggcggctgccggcaggaggcgccgagccgggtgactgccgcggcgggcacagtccggggccacagcgccgagcccgggcgggagtggccccgcgcaggcagggagcggcgccgcgcactccaacccggcgggcacctcgggggcgggcgcggggcgcagccttctcgtcccggcctctgtgacaagcgccccggagccgggagcccgattgccgggctcggggtgggcgcggacgcaggcactgggctcgtgcggggccccgggcgtcgcgatgaacatcgtggtggagttcttcgtggtcactttcaaagtgctctgggcgttcgtgctggccgcggcgcgctggctggtgcggcccaaggagaagagcgtggcgggccaggtgtgcctcatcaccggcgccggcagcggcctgggccgcctcttcgcgctggagttcgcccggcgtcgggcgctgctggtgctgtgggacatcaacacgcaaagcaacgaggagacggctggcatggtgcgccacatctaccgcgacctggaggcggccgacgccgctgcgctgcaagctgggaatggtgaggaagaaattctgccccactgtaacttgcaggtttttacctacacctgtgacgtggggaagagggagaacgtctacctgacggctgaaagagtccgcaaggaggttggcgaagtctcagtcctggtcaataatgctggtgtggtctctgggcatcaccttctggaatgtcctgatgagctcattgagagaaccatgatggtcaattgccatgcacacttctggaccactaaggcttttcttcctacgatgctggagattaatcatggtcatattgtgacagttgcaagttccttgggattgttcagtactgccggagttgaggattactgtgccagtaaatttggagttgtgggttttcatgaatccctgagccatgaactaaaggctgctgaaaaggatggaattaaaacaaccttggtttgcccttatcttgtagacactggcatgttcagaggctgccgaatcaggaaagaaattgagccttttctgccacctctgaagcctgattactgtgtgaagcaggccatgaaggccatcctcactgaccagcccatgatctgcactccccgcctcatgtacatcgtgaccttcatgaagagcatcctaccatttgaagcagttgtgtgcatgtatcggttcctaggagcggacaagtgtatgtacccctttattgctcaaagaaagcaagccacaaacaataatgaagcaaaaaatggaatctaagaatctttttgtatggaatattacttctatcagaagatgatcaagatgtttcagtccagtgcacatcagcattgctgacattttatggattctaaacttgtgttgtttcttttttaaatcaactttttaaaaaaataaagtgtaaattaaccgactagagtacttggaaaatgtgatcagtacaagtgaacttaggttgttgccaacagggtccttttaggcagaacccagaaaccagtcaaatctgtagagaagcagtgtgacatcttcaggttaccattattttttaatgagcaggaagtctagaaatgataactagactgtatgtttcatgtgtgtgatttttcagaattcccagagtttactcattcttgttattaaactctagccagttgacatcttcgcaatttcaaggactgatagtgctgtattttctcacgttttctaagtttccgttttgcaaggcctaggtgactttttcatggtgtttgtatgtttagctcttttgaaaaggaattttgaaatctccatcaactgaagtaaatgatgtctgagtgttacagtwaaggtgaccaagtctctttcttaaagtcacaatgactaaagtattagttgaatttttttttttttttttgatggagtctcgctctgtcaccaggctggagtgcagtagcacaatcacggctcactgcaatctctgcctcccrgtttcaagtgattctgctgtctcagcctcccaagtagctgggactacaggcatgcgccaccacgcccagctaatttttgtatttttagtagagacggggtttcaccatgttggtcaggatggtctccatctcttgacattgtgatccacctgcctcggcctcccaaagtgctgggattacaggcatgagccactgcacccagccttgaatttttaattttatctctgatatacttcattaagtgtctggagacctaattatcctaaaagatcatacattttctacctatgaattttgctgcatacagaaagtgccctttcctcaggaagttgctgtgtttcatttctttggatggactcttatctagaatacatagcagctctgcaaagaaacagtttttaaaaatgggaacttctacattgaaaagtccccatttttgtgccaactatgattagtgagaggaagaaatcttattctatggcatatgtatggaagggtgtaaagattcttttgaaaggtttattcacattgtagaacagcaaatgacatttttacagtatttttttgtaaagcaaactattttgtgccttgaatttggtatatgtgtattagtgaaacattgtaaaggtgaacttctacctctgtatctaaatgtataccatccacttgtaaatgactataaactattatgtgattgcttttttttttagaatgtcttgtttaaatagtggccaatgtttaaggctgttaaaataagccaacttttactaattggggagttttataaatgactgattaaatttaaagaattaacttacatgcaattgtgtgattattagttatcagcagtgttgtaaggaaaattattgtgtttttttttatgatcattatcccactttaggtaaagaaaaatattggaatggaatagtgttgggaaacagacattaacaacctagggtgcctgcactcaaatagccgatgttactgtccctagattagagacttgattaagggcttgtttgtaccaaaagtggggaaacaatgccatgacctgtgttttagtttggctgcaccacagatcaaatctgcactgtgtctacatataggaaaggtcctggtgtgtgctaatgttcccaatgcaggacttgaggaagagctctgttatatgtttccatttctctttatcaaagataaccaaaccttatggcccttataacaatggaggcactggctgcctcttaattttcaatcatggacctaaagaagtactctgaagggtctcaacaatgccaggtggggacagatatactcagagattatccaggtctgcctcccagcgagcctggagtacaccagaccctcctagagaaatctgttataatttaacaacccacttatccaccttaaaactgaggaaagtcgtctttacatctaattttattcttgtgtgttataacttaaacctatttctatttttgtttgttattgcccttataagggtgtccatctccaagttcaataaactaattcatttaaaaaaaaaaaaaaaaaaa

SEQ ID NO: 80 - protein, 341 aa, Homo Sapiens
MNIVVEFFVVTFKVLWAFVLAAARWLVRPKEKSVAGQVCLITGAGSGLGRLFALEFARRRALLVLWDINTQSNEETAGMVRHIYRDLEAADAAALQAGNGEEEILPHCNLQVFTYTCDVGKRENVYLTAERVRKEVGEVSVLVNNAGVVSGHHLLECPDELIERTMMVNCHAHFWTTKAFLPTMLEINHGHIVTVASSLGLFSTAGVEDYCASKFGVVGFHESLSHELKAAEKDGIKTTLVCPYLVDTGMFRGCRIRKEIEPFLPPLKPDYCVKQAMKAILTDQPMICTPRLMYIVTFMKSILPFEAVVCMYRFLGADKCMYPFIAQRKQATNNNEAKNGI

SEQ ID NO: 81 - DNA, 1026 bp, Homo Sapiens
  CDS (1)...(1026)
atgaacatcgtggtggagttcttcgtggtcactttcaaagtgctctgggcgttcgtgctggccgcggcgcgctggctggtgcggcccaaggagaagagcgtggcgggccaggtgtgcctcatcaccggcgccggcagcggcctgggccgcctcttcgcgctggagttcgcccggcgtcgggcgctgctggtgctgtgggacatcaacacgcaaagcaacgaggagacggctggcatggtgcgccacatctaccgcgacctggaggcggccgacgccgctgcgctgcaagctgggaatggtgaggaagaaattctgccccactgtaacttgcaggtttttacctacacctgtgacgtggggaagagggagaacgtctacctgacggctgaaagagtccgcaaggaggttggcgaagtctcagtcctggtcaataatgctggtgtggtctctgggcatcaccttctggaatgtcctgatgagctcattgagagaaccatgatggtcaattgccatgcacacttctggaccactaaggcttttcttcctacgatgctggagattaatcatggtcatattgtgacagttgcaagttccttgggattgttcagtactgccggagttgaggattactgtgccagtaaatttggagttgtgggttttcatgaatccctgagccatgaactaaaggctgctgaaaaggatggaattaaaacaaccttggtttgcccttatcttgtagacactggcatgttcagaggctgccgaatcaggaaagaaattgagccttttctgccacctctgaagcctgattactgtgtgaagcaggccatgaaggccatcctcactgaccagcccatgatctgcactccccgcctcatgtacatcgtgaccttcatgaagagcatcctaccatttgaagcagttgtgtgcatgtatcggttcctaggagcggacaagtgtatgtacccctttattgctcaaagaaagcaagccacaaacaataatgaagcaaaaaatggaatctaa

SEQ ID NO: 82 - DNA, 1327 bp, Homo Sapiens
  CDS (367)...(1188)
cctgctgcaatggcttacgggagccaatgtgacgggatcagggcagacccatttagggtttcgtaaccggccaattcagtacgcaatagggaaaatcaattaggatctgcagagggttcccggatacaccttgcgaagaatgccgcactctccgccactcattccccactcaccggcacccgctaaaccttcagcctgaaattttcctccgaaggaagcagagcagaggaagaactaccaagtgctacactcaaagcctgccgtcgcagtgagcgcgacctccaaactgaggcatttttgttccggcgaaatccctcccactcaggaaagtccctagaaagagagcgcaggcgcctggggtatcacatgaccacttcccggaagcgcagcagacccgctcaacttcatcctgggttgaggcggaggagaacttccagaattatggcgaagtccgggctgaggcaggacccgcagagcacagctgcagccactgtgctaaagcgggcagtagaactagattcggagtcgcggtatccgcaggctctggtgtgttaccaagaggggattgatctgctcctgcaggttctgaaaggtaccaaagataatactaagagatgtaatctcagagaaaaaatttccaaatacatggacagagcggaaaacataaagaagtacttggaccaagaaaaagaagatggaaaatatcacaagcaaattaaaatagaagagaatgcaacaggtttcagttatgagtcactttttcgcgaataccttaatgagacagttacagaagtttggatagaagatccttatattagacatactcatcagctgtataactttcttcgattttgtgagatgcttattaagagaccatgtaaagtaaaaactattcaccttctcacctctctggatgaaggcattgagcaagtgcagcaaagtagaggcctgcaagaaatagaagagtcactcaggagtcacggagtgctgttggaagttcaatactcttcttcaatacatgaccgagaaattaggttcaacaatggatggatgattaagattggaaggggacttgattattttaagaaaccacagagtcgtttttcccttggatattgtgattttgatttaagaccatgtcatgaaacaacagtagacatttttcataagaagcatacaaaaaatatatgatgggtggtagcctaatttgtattatgtctactttaagtgaatattggattttttttaaaagatcacttttataatgtatgaatttaacaataaacttttatatttctactaaaaaaaaaaaaaaaaaaaaaaaaaa

SEQ ID NO: 83 - protein, 274 aa, Homo Sapiens
MTTSRKRSRPAQLHPGLRRRRTSRIMAKSGLRQDPQSTAAATVLKRAVELDSESRYPQALVCYQEGIDLLLQVLKGTKDNTKRCNLREKISKYMDRAENIKKYLDQEKEDGKYHKQIKIEENATGFSYESLFREYLNETVTEVWIEDPYIRHTHQLYNFLRFCEMLIKRPCKVKTIHLLTSLDEGIEQVQQSRGLQEIEESLRSHGVLLEVQYSSSIHDREIRFNNGWMIKIGRGLDYFKKPQSRFSLGYCDFDLRPCHETTVDIFHKKHTKNI

SEQ ID NO: 84 - DNA, 825 bp, Homo Sapiens
  CDS (1)...(825)
atgaccacttcccggaagcgcagcagacccgctcaacttcatcctgggttgaggcggaggagaacttccagaattatggcgaagtccgggctgaggcaggacccgcagagcacagctgcagccactgtgctaaagcgggcagtagaactagattcggagtcgcggtatccgcaggctctggtgtgttaccaagaggggattgatctgctcctgcaggttctgaaaggtaccaaagataatactaagagatgtaatctcagagaaaaaatttccaaatacatggacagagcggaaaacataaagaagtacttggaccaagaaaaagaagatggaaaatatcacaagcaaattaaaatagaagagaatgcaacaggtttcagttatgagtcactttttcgcgaataccttaatgagacagttacagaagtttggatagaagatccttatattagacatactcatcagctgtataactttcttcgattttgtgagatgcttattaagagaccatgtaaagtaaaaactattcaccttctcacctctctggatgaaggcattgagcaagtgcagcaaagtagaggcctgcaagaaatagaagagtcactcaggagtcacggagtgctgttggaagttcaatactcttcttcaatacatgaccgagaaattaggttcaacaatggatggatgattaagattggaaggggacttgattattttaagaaaccacagagtcgtttttcccttggatattgtgattttgatttaagaccatgtcatgaaacaacagtagacatttttcataagaagcatacaaaaaatatatga

SEQ ID NO: 85 - protein, 206 aa, Artificial Sequence
  Consensus amino acid sequence
KVALVTGASSGIGLAIAKRLAKEGAKVVVADRNEEKLEKGAVAKELKELGGNDKDRALAIQLDVTDEESVKAAVEQAVERLGRGLDVLVNNAGGIILLRPGPFAELSRTMEEDWDRVIDVNLTGVFLLTRAVLPLMAMKKRGGGRIVNISSVAGRKEGGLVGVPGGSAYSASKAAVIGLTRSLALELAPHGGIRVNAVAPGGVDTD

SEQ ID NO: 86 - protein, 34 aa, Artificial Sequence
  Consensus amino acid sequence
AEAYYNLGNAYLKLGKYDEAIEDYEKALELDPNN

SEQ ID NO: 87 - protein, 228 aa, Artificial Sequence
  Consensus amino acid sequence
AKELLIRAVECDQVGRILEAQTLYTEGIGQLMQFVNGEPDEAKRKGFLTRIKEYMDRADAIKARINGKLMLGEVVSHVSIDENDTGFDYDQLFGKYMDDKTVEIMLEEPYMTQNYQYQNLIRFLELAATNCPNLKYFRLITKEYKDAKNPDQQETNLGQIKGDLERRNVTVYIKYEDSLHDRKIYLSNGYIIKIGRGLHFYKPANPMYSIGLVNYKFRKCLQTDVDIW

SEQ ID NO: 88 - protein, 59 aa, Artificial Sequence
  Consensus amino acid sequence
AIDLVQKAIDEDKAGQYEEAYQLYQHALDYFMHALKYEAKNDKSKEIIRAKCTEYLDRA

SEQ ID NO: 89 - DNA, 1808 bp, Homo Sapiens
  CDS (285)...(1418)
ggagtcgacccacgcgtccgggagcagcggccggggcggcagcggtccccaggccgggacacccggggtggtgcgcccgggttcgcgggggctgcgccggcgccggggaggcggggggagcgggagcgggcgacgcggggaaggggggagccagggggagggcgccggccggaggaggggcggacccgccgccctagccgagcagagcacagccgagccgagcggcccgggcgggggccgaccccggccagcgtcggcgcagagagcgggcggaggcgcaggccatgctgcggctggtgcccaccggggcccgggccatcgtggacatgtcgtacgcccgccacttcctggacttccagggctccgccattccccaagccatgcagaagctggtggtgacccggctgagccccaacttccgcgaggccgtcaccctgagccgggactgcccggtgccgctccccggggacggagacctcctcgtccggaaccgatttgttggtgttaacgcatctgacatcaactattcagcaggccgctatgacccctcagttaagcctccctttgacataggtttcgaaggcattggggaggtggtggccctaggcctctctgctagtgccagatacacagttggccaagctgtggcttacatggcacctggttcttttgctgagtacacagttgtgcctgccagcattgcaactccagtgccctcagtgaaacccgagtatcttaccctgctggtaagtggcaccaccgcatacatcagcctgaaagagctcggaggactgtcggaagggaaaaaagttttggtgacagcagcagctgggggaacgggccagtttgccatgcagctttcaaagaaggcaaagtgccatgtaattggaacctgctcttctgatgaaaagtctgcttttctgaaatctcttggctgtgatcgtcctatcaactataaaactgaacccgtaggtaccgtccttaagcaggagtaccctgaaggtgtcgatgtggtctatgaatctgttgggggagccatgtttgacttggctgtagacgccctggctacgaaagggcgcttgatagtaatagggtttatctctggctaccaaactcctactggcctttcgcctgtgaaagcaggaacattgccagccaaactgctcaagaaatctgccagcgtacagggcttcttcctgaaccattacctttctaagtatcaagcagccatgagccacttgctcgagatgtgtgtgagcggagacctggtttgtgaggtggaccttggagatctgtctccagagggcaggtttactggcctggagtccatattccgtgctgtcaattatatgtacatgggaaaaaacactggaaaaattgtagttgaattacctcactctgtcaacagtaagctgtaaaaacagaacaatgacataaatcaagggagaaagaaaatgggcactttatgtctcagaattactcaaatcaatttatttttagttggtaatggatataatatttcttaaaacaaaagtaaggtgttaatgaataggtctctccttctcctcctcctcctcctcttcccttgggggaaaaaaaaaaatgtgctaataaaacttccctccatggctaagagggaaaacgcttacattcaattctttagtcatggatggtctcgttccagatgttattgttccagggaactaaattcattcctgatgccagatctgatcgagkcagtatgtcttcagcttggatcaggattttaaaatcagttttgaaagtgggttcccgacttctttggcttt

SEQ ID NO: 90 - protein, 377 aa, Homo Sapiens
MLRLVPTGARAIVDMSYARHFLDFQGSAIPQAMQKLVVTRLSPNFREAVTLSRDCPVPLPGDGDLLVRNRFVGVNASDINYSAGRYDPSVKPPFDIGFEGIGEVVALGLSASARYTVGQAVAYMAPGSFAEYTVVPASIATPVPSVKPEYLTLLVSGTTAYISLKELGGLSEGKKVLVTAAAGGTGQFAMQLSKKAKCHVIGTCSSDEKSAFLKSLGCDRPINYKTEPVGTVLKQEYPEGVDVVYESVGGAMFDLAVDALATKGRLIVIGFISGYQTPTGLSPVKAGTLPAKLLKKSASVQGFFLNHYLSKYQAAMSHLLEMCVSGDLVCEVDLGDLSPEGRFTGLESIFRAVNYMYMGKNTGKIVVELPHSVNSKL

SEQ ID NO: 91 - DNA, 1134 bp, Homo Sapiens
  CDS (1)...(1134)
atgctgcggctggtgcccaccggggcccgggccatcgtggacatgtcgtacgcccgccacttcctggacttccagggctccgccattccccaagccatgcagaagctggtggtgacccggctgagccccaacttccgcgaggccgtcaccctgagccgggactgcccggtgccgctccccggggacggagacctcctcgtccggaaccgatttgttggtgttaacgcatctgacatcaactattcagcaggccgctatgacccctcagttaagcctccctttgacataggtttcgaaggcattggggaggtggtggccctaggcctctctgctagtgccagatacacagttggccaagctgtggcttacatggcacctggttcttttgctgagtacacagttgtgcctgccagcattgcaactccagtgccctcagtgaaacccgagtatcttaccctgctggtaagtggcaccaccgcatacatcagcctgaaagagctcggaggactgtcggaagggaaaaaagttttggtgacagcagcagctgggggaacgggccagtttgccatgcagctttcaaagaaggcaaagtgccatgtaattggaacctgctcttctgatgaaaagtctgcttttctgaaatctcttggctgtgatcgtcctatcaactataaaactgaacccgtaggtaccgtccttaagcaggagtaccctgaaggtgtcgatgtggtctatgaatctgttgggggagccatgtttgacttggctgtagacgccctggctacgaaagggcgcttgatagtaatagggtttatctctggctaccaaactcctactggcctttcgcctgtgaaagcaggaacattgccagccaaactgctcaagaaatctgccagcgtacagggcttcttcctgaaccattacctttctaagtatcaagcagccatgagccacttgctcgagatgtgtgtgagcggagacctggtttgtgaggtggaccttggagatctgtctccagagggcaggtttactggcctggagtccatattccgtgctgtcaattatatgtacatgggaaaaaacactggaaaaattgtagttgaattacctcactctgtcaacagtaagctgtaa

SEQ ID NO: 92 - DNA, 3296 bp, Homo Sapiens
  CDS (217)...(2031)
  misc_feature (1)...(3296): n = A,T,C or G
cgcgtncgcgtggcgyccscgnmcgsgysggcccccgcgtccgggcnggacrcgkggscgcggggagcagctcgggactgaaccgagaggtgccgaaggaaccggcgggccgcttgatcccgctgcagacgtaggagatgcctgggacaaggaggccaccttctcagggcaaaagaaaaagaaggtgacaggcgttgagaccaccgaagggaacccatggctaggatcagtttttcctacctctgcccagcctcctggtacttcactgtgcccacagtgagtccatttctccgtcagcgggtggcattcctgggactcttcttcatatcctgtctccttttacttatgttaatcatagactttcgacattggagtgcttcattaccacgagataggcaatacgaaaggtatttggctcgagtaggggagcttgaagctactgacactgaagacccaaatctgaattatggacttgttgttgactgtggcagcagtggttcccggatttttgtttatttctggccaagacataatgggaacccccatgacttgctggacatcaaacagatgagagaccgcaacagccaaccagtggttaaaaaaatcaagccaggaatctctgcaatggcagacactccagaacatgccagtgattaccttcgtcctctgctgagctttgctgctgctcatgtgcctgtgaagaagcacaaggagacccctctttacatcctctgcacagcaggcatgaggcttctccctgagaggaagcagttggctatcttggctgacctagtgaaagatttaccactggagtttgacttcctcttttcacagtctcaagcagaagtgatctctgggaagcaggaaggggtttatgcatggattggaatcaactttgttttgggaagattcgaccacgaggatgaatcagatgctgaggctacccaggaattggcagcaggacggagaaggacagtagggatactggatatgggaggagcctctctccaaattgcttatgaagttcctacctcaacctctgtccttcctgcaaagcaggaagaagctgccaagatcctgctggctgagttcaacctgggctgtgatgtgcaacacactgaacacgtgtacagggtttatgtcacaacttttctgggtttcggaggcaactttgcccggcagcgctacgaagaccttgttctgaatgaaactcttaacaaaaacagattgcttggtcagaagacaggtctgagtcccgacaatccatttctggatccctgcctgccagtgggactcacagatgtggtggagaggaacagccaagtcttacatgtccgaggaagaggagactgggtgtcttgtggggcaatgctgagccccctgctggctcgctccaacaccagccaggcctcactcaatggcatatatcaatcgcctattgacttcaacaacagcgagttctacggcttctctgagtttttttattgtacagaggatgtgttgcgcattggtggccgctaccatgggccaacatttgccaaggctgctcaggattactgtggcatggcttggtcggtactaactcagagattcaagaatggcctcttttcatcacatgcagatgagcatcgactcaaatatcagtgttttaaatcggcttggatgtaccaagtcttacatgaaggattccactttccctatgactacccaaacctgcggacagcccagctggtgtatgaccgagaggttcagtggacgctgggagccattctatataaaacacgattcttaccactcagggatcttcggcaggaaggtgtccgacaagcccatggtagctggttccgtctctcctttgtatacaaccactatctcttctttgcctgtatcctggtggtgctactggccatcttcctataccttctgcggctacgccgaattcaccaccgacaaacacgagcctcagctccattggacttgctgtggcttgaagaggtggtgcccatgatgggagtacaggtggggccgtgaggctggaccaggactagagaagcttgagcacccccgagttgctgctcattgaattcctccactttcttatatagcctcagatgctgtgatgtctgaccttgtggatatttgcccttggaatttctactttactttctaccgtaattccttctccgtacccaggtcttctctgagagaagctataatttaatctgtgaggaactaaatgacaggagattggtgctaatacgggggaccaagctttgtccaagtgaagcaggcttcgactccttctgagaggtctggtgtgttcctagaatctcaccttttcttcccttgctaaagcatgaagtttggcatttggcacactggaagcctggttgaaatgaaatttgtagcatctgatacaaagccagagacattctagcaagtgcagcagccccttctttctctgtaacagagatatcatttatgtggagatccacaacctttaacagggatccaagatctttgcagttcaatcgaccacataggaatttccaggcaccaaaatgatataacttccttgcttccttgacaaagaagccatcatgggtgtgatccaagatccctgtcgtagtgttgatgatgttagtacatgattttaaaggttagaaccccttctaaatgaatggtctgtggaagattttagtatcttatctgatgcctggtatgatgaggatagaaaatttttccatttttatgtgcctcacaggctgtttgggcattaattttgctttttgagccttaagtgtgttagtaggatggagaaactgtgatggggactgggaacctggatttgtctgattttaggtcactgttccctgggcctgtttttgtgagcccttacacaggaagatataaagagagttctttcatttcactgctaaaatcagtatgtagtatggggaatgtatttgggttgtttttaaagaaaaggggaacagaatcaggagagtgggcaaaggcaataaaatcaaagttcttattaattatttctgagaaatagaagtttctcaatttatgactcttggaatgtctgaaagggagcaaatttggaatagatcaatctgttaataagccatctggcaactttcagaacctctattaagagactgctgagtcacaaacagcacttccattaatgaagcgagaggaaaagccataataattacatcttcacccactacccttccagagctttgcttctcctccacatttagccattaaattgcatgaggatttct

SEQ ID NO: 93 - protein, 604 aa, Homo Sapiens
MARISFSYLCPASWYFTVPTVSPFLRQRVAFLGLFFISCLLLLMLIIDFRHWSASLPRDRQYERYLARVGELEATDTEDPNLNYGLVVDCGSSGSRIFVYFWPRHNGNPHDLLDIKQMRDRNSQPVVKKIKPGISAMADTPEHASDYLRPLLSFAAAHVPVKKHKETPLYILCTAGMRLLPERKQLAILADLVKDLPLEFDFLFSQSQAEVISGKQEGVYAWIGINFVLGRFDHEDESDAEATQELAAGRRRTVGILDMGGASLQIAYEVPTSTSVLPAKQEEAAKILLAEFNLGCDVQHTEHVYRVYVTTFLGFGGNFARQRYEDLVLNETLNKNRLLGQKTGLSPDNPFLDPCLPVGLTDVVERNSQVLHVRGRGDWVSCGAMLSPLLARSNTSQASLNGIYQSPIDFNNSEFYGFSEFFYCTEDVLRIGGRYHGPTFAKAAQDYCGMAWSVLTQRFKNGLFSSHADEHRLKYQCFKSAWMYQVLHEGFHFPYDYPNLRTAQLVYDREVQWTLGAILYKTRFLPLRDLRQEGVRQAHGSWFRLSFVYNHYLFFACILVVLLAIFLYLLRLRRIHHRQTRASAPLDLLWLEEVVPMMGVQVGP

SEQ ID NO: 94 - DNA, 1815 bp, Homo Sapiens
  CDS (1)...(1815)
atggctaggatcagtttttcctacctctgcccagcctcctggtacttcactgtgcccacagtgagtccatttctccgtcagcgggtggcattcctgggactcttcttcatatcctgtctccttttacttatgttaatcatagactttcgacattggagtgcttcattaccacgagataggcaatacgaaaggtatttggctcgagtaggggagcttgaagctactgacactgaagacccaaatctgaattatggacttgttgttgactgtggcagcagtggttcccggatttttgtttatttctggccaagacataatgggaacccccatgacttgctggacatcaaacagatgagagaccgcaacagccaaccagtggttaaaaaaatcaagccaggaatctctgcaatggcagacactccagaacatgccagtgattaccttcgtcctctgctgagctttgctgctgctcatgtgcctgtgaagaagcacaaggagacccctctttacatcctctgcacagcaggcatgaggcttctccctgagaggaagcagttggctatcttggctgacctagtgaaagatttaccactggagtttgacttcctcttttcacagtctcaagcagaagtgatctctgggaagcaggaaggggtttatgcatggattggaatcaactttgttttgggaagattcgaccacgaggatgaatcagatgctgaggctacccaggaattggcagcaggacggagaaggacagtagggatactggatatgggaggagcctctctccaaattgcttatgaagttcctacctcaacctctgtccttcctgcaaagcaggaagaagctgccaagatcctgctggctgagttcaacctgggctgtgatgtgcaacacactgaacacgtgtacagggtttatgtcacaacttttctgggtttcggaggcaactttgcccggcagcgctacgaagaccttgttctgaatgaaactcttaacaaaaacagattgcttggtcagaagacaggtctgagtcccgacaatccatttctggatccctgcctgccagtgggactcacagatgtggtggagaggaacagccaagtcttacatgtccgaggaagaggagactgggtgtcttgtggggcaatgctgagccccctgctggctcgctccaacaccagccaggcctcactcaatggcatatatcaatcgcctattgacttcaacaacagcgagttctacggcttctctgagtttttttattgtacagaggatgtgttgcgcattggtggccgctaccatgggccaacatttgccaaggctgctcaggattactgtggcatggcttggtcggtactaactcagagattcaagaatggcctcttttcatcacatgcagatgagcatcgactcaaatatcagtgttttaaatcggcttggatgtaccaagtcttacatgaaggattccactttccctatgactacccaaacctgcggacagcccagctggtgtatgaccgagaggttcagtggacgctgggagccattctatataaaacacgattcttaccactcagggatcttcggcaggaaggtgtccgacaagcccatggtagctggttccgtctctcctttgtatacaaccactatctcttctttgcctgtatcctggtggtgctactggccatcttcctataccttctgcggctacgccgaattcaccaccgacaaacacgagcctcagctccattggacttgctgtggcttgaagaggtggtgcccatgatgggagtacaggtggggccgtga

SEQ ID NO: 95 - DNA, 2090 bp, Homo Sapiens
  CDS (129)...(1733)
cgaccacgcgtccgcgctccagccgccgcgcatcctcggcccgcgccccgagacccgcgcccagctagccccggccccgctcggcgccccaggcagctcggctgcgctcgccgcgggacggcgcggccatgaggctgcggggatgcggaccccgggccgcccctgcctccagcgcaggggccagcgacgctcggctgctggcgcccccggggcggaaccccttcgtgcacgagctgcgcctcagcgccctgcagaaggcccaggtggccctcatgacactgacgctcttcccggtccggctcctggttgccgctgccatgatgctgctggcctggcccctcgcacttgtcgcatccctgggctctgcggagaaggaacccgagcagcccccggccctgtggaggaaggttgtggacttcctgctgaaggccatcatgcgcaccatgtggttcgccggcggcttccaccgggtggccgtgaaggggcggcaggcgctgcccaccgaggcggccatcctcacgctcgcgcctcactcgtcctacttcgacgccatccctgtgaccatgacgatgtcctccatcgtgatgaaggcagagagcagagacatcccgatctggggaactctgatccagtatatacggcctgtgttcgtgtcccggtcagaccaggattctcgcaggaaaacagtagaagaaatcaagagacgggcgcagtccaacggaaagtggccacagataatgatttttccagaaggaacttgtacaaacaggacctgcctaattaccttcaaacctggtgcattcatccctggagcgcccgtccagcctgtggttttacgatatccaaataaactggacaccatcacatggacgtggcaaggacctggagcgctggaaatcctgtggctcacgctgtgtcagtttcacaaccaagtggaaatcgagttccttcctgtgtacagcccttctgaggaggagaagaggaaccccgcgctgtatgccagcaacgtgcggcgagtcatggccgaggccttgggtgtctccgtgactgactacacgttcgaggactgccagctggccctggcggaaggacagctccgtctccccgctgacacttgccttttagaatttgccaggctcgtgcggggcctcgggctaaaaccagaaaagcttgaaaaagatctggacagatactcagaaagagccaggatgaagggaggagagaagataggtattgcggagtttgccgcctccctggaagtccccgtttctgacttgctggaagacatgttttcactgttcgacgagagcggcagcggcgaggtggacctgcgagagtgtgtggttgccctgtctgtcgtctgccggccggcccggaccctggacaccatccagctggctttcaagatgtacggagcgcaagaggacggcagcgtcggcgaaggtgacctgtcctgcatcctcaagacggccctgggggtggcagagctcaccgtgaccgacctattccgagccattgaccaagaggagaaggggaagatcacattcgctgacttccacaggtttgcagaaatgtaccctgccttcgcagaggaatacctgtacccggatcagacacatttcgaaagctgtgcagagacctcacctgcgccaatcccaaacggcttctgtgccgatttcagcccggaaaactcagacgctgggcggaagcctgttcgcaagaagctggattaggacccagggttgcggagagacgcggcccctcccgcgtggacatcaccgccatgagcctctttgcgagtgacctctgggctccgctcctcactcctgctgtacaggcactgtcttcagcccgagttccaggggcctcgggggctgtttgtatcttgttcctttgtgaagtgtgttgcagaaccgacgcttactgtgcgagaatcggagggcgcgcacgccggatcccccgcctggcctggaccccgtggggtcaggttccctgccgggcggggggcaccggtgccgccccgtgttctcccacggggccctggtttcgagtctctggcacagcctcttccggcggcagcgtgcaccggg

SEQ ID NO: 96 - protein, 534 aa, Homo Sapiens
MRLRGCGPRAAPASSAGASDARLLAPPGRNPFVHELRLSALQKAQVALMTLTLFPVRLLVAAAMMLLAWPLALVASLGSAEKEPEQPPALWRKVVDFLLKAIMRTMWFAGGFHRVAVKGRQALPTEAAILTLAPHSSYFDAIPVTMTMSSIVMKAESRDIPIWGTLIQYIRPVFVSRSDQDSRRKTVEEIKRRAQSNGKWPQIMIFPEGTCTNRTCLITFKPGAFIPGAPVQPVVLRYPNKLDTITWTWQGPGALEILWLTLCQFHNQVEIEFLPVYSPSEEEKRNPALYASNVRRVMAEALGVSVTDYTFEDCQLALAEGQLRLPADTCLLEFARLVRGLGLKPEKLEKDLDRYSERARMKGGEKIGIAEFAASLEVPVSDLLEDMFSLFDESGSGEVDLRECVVALSVVCRPARTLDTIQLAFKMYGAQEDGSVGEGDLSCILKTALGVAELTVTDLFRAIDQEEKGKITFADFHRFAEMYPAFAEEYLYPDQTHFESCAETSPAPIPNGFCADFSPENSDAGRKPVRKKLD

SEQ ID NO: 97 - DNA, 1605 bp, Homo Sapiens
  CDS (1)...(1605)
atgaggctgcggggatgcggaccccgggccgcccctgcctccagcgcaggggccagcgacgctcggctgctggcgcccccggggcggaaccccttcgtgcacgagctgcgcctcagcgccctgcagaaggcccaggtggccctcatgacactgacgctcttcccggtccggctcctggttgccgctgccatgatgctgctggcctggcccctcgcacttgtcgcatccctgggctctgcggagaaggaacccgagcagcccccggccctgtggaggaaggttgtggacttcctgctgaaggccatcatgcgcaccatgtggttcgccggcggcttccaccgggtggccgtgaaggggcggcaggcgctgcccaccgaggcggccatcctcacgctcgcgcctcactcgtcctacttcgacgccatccctgtgaccatgacgatgtcctccatcgtgatgaaggcagagagcagagacatcccgatctggggaactctgatccagtatatacggcctgtgttcgtgtcccggtcagaccaggattctcgcaggaaaacagtagaagaaatcaagagacgggcgcagtccaacggaaagtggccacagataatgatttttccagaaggaacttgtacaaacaggacctgcctaattaccttcaaacctggtgcattcatccctggagcgcccgtccagcctgtggttttacgatatccaaataaactggacaccatcacatggacgtggcaaggacctggagcgctggaaatcctgtggctcacgctgtgtcagtttcacaaccaagtggaaatcgagttccttcctgtgtacagcccttctgaggaggagaagaggaaccccgcgctgtatgccagcaacgtgcggcgagtcatggccgaggccttgggtgtctccgtgactgactacacgttcgaggactgccagctggccctggcggaaggacagctccgtctccccgctgacacttgccttttagaatttgccaggctcgtgcggggcctcgggctaaaaccagaaaagcttgaaaaagatctggacagatactcagaaagagccaggatgaagggaggagagaagataggtattgcggagtttgccgcctccctggaagtccccgtttctgacttgctggaagacatgttttcactgttcgacgagagcggcagcggcgaggtggacctgcgagagtgtgtggttgccctgtctgtcgtctgccggccggcccggaccctggacaccatccagctggctttcaagatgtacggagcgcaagaggacggcagcgtcggcgaaggtgacctgtcctgcatcctcaagacggccctgggggtggcagagctcaccgtgaccgacctattccgagccattgaccaagaggagaaggggaagatcacattcgctgacttccacaggtttgcagaaatgtaccctgccttcgcagaggaatacctgtacccggatcagacacatttcgaaagctgtgcagagacctcacctgcgccaatcccaaacggcttctgtgccgatttcagcccggaaaactcagacgctgggcggaagcctgttcgcaagaagctggattag

SEQ ID NO: 98 - protein, 195 aa, Artificial Sequence
  Consensus amino acid sequence
LENLPKKGPAIVVSNHRSYLDILVLSAALPRRGPWLVRRLVFIAKKELLKVPLLFGWLMRLAGAIFIDRNNRAKDALAAADELVRVLELLRKGRSVLIFPEGTRSRSGELLPPFKKGIAAFRLALKAGVPIVPVVIVSGTEELEPKNEAGKLLRLARKKGPVTVRVLPPIPLDPEDIKELAERLRDILVQALEEL

SEQ ID NO: 99 - protein, 7 aa, Artificial Sequence
  Conserved Motif
  VARIANT (1)...(1): Xaa at position 1 can be Asn or any amino acid
  VARIANT (3)...(3): Xaa at position 3 can Arg or Gln
  VARIANT (5)...(5): Xaa at position 5 can be any amino acid
  VARIANT (6)...(6): Xaa at position 6 can be Leu, Tyr, Ile, or Met
  VARIANT (1)...(7): Xaa = Any Amino Acid
XHXSXXD

SEQ ID NO: 100 - protein, 7 aa, Artificial Sequence
  Conserved Motif
  VARIANT (2)...(2): Xaa at position 2 can be any amino acid
  VARIANT (3)...(3): Xaa at position 3 can be Ile or Phe
  VARIANT (6)...(6): Xaa at position 6 can be Arg or Asp
  VARIANT (1)...(7): Xaa = Any Amino Acid
GXXFIXR

SEQ ID NO: 101 - protein, 8 aa, Artificial Sequence
  Conserved Motif
  VARIANT (2)...(2): Xaa at position 2 can be Pro, Leu, or Ile
  VARIANT (5)...(5): Xaa at position 5 can be Thr or Gly
  VARIANT (7)...(7): Xaa at position 7 can be Ser or any amino acid
  VARIANT (8)...(8): Xaa at position 8 can be Arg or any amino acid
  VARIANT (1)...(8): Xaa = Any Amino Acid
FXEGXRXX

SEQ ID NO: 102 - protein, 6 aa, Artificial Sequence
  Conserved Motif
  VARIANT (1)...(1): Xaa at position 1 can be Val or Ile
  VARIANT (2)...(2): Xaa at position 2 can be Pro or any amino acid
  VARIANT (3)...(3): Xaa at position 3 can be Ile, Val, or Leu
  VARIANT (4)...(4): Xaa at position 4 can be Val or Ile
  VARIANT (6)...(6): Xaa at position 6 can be Val or Ile
XXXXPX

SEQ ID NO: 103 - protein, 7 aa, Homo Sapiens
PHSSYFD

SEQ ID NO: 104 - protein, 7 aa, Homo Sapiens
RPVFVSR

SEQ ID NO: 105 - protein, 8 aa, Homo Sapiens
FPEGTCTN

SEQ ID NO: 106 - protein, 6 aa, Homo Sapiens
APVQPV

SEQ ID NO: 107 - DNA, 1287 bp, Homo Sapiens
  CDS (99)...(1055)
gaccacgcgtccgcggacgcgtgggcggacgcgtgggcggacgcgtgggctagcgggcggtgggggcgccagcagcgcggaaggcgggcacgcgggccatggctccctgggcggaggccgagcactcggcgctgaacccgctgcgcgcggtgtggctcacgctgaccgccgccttcctgctgaccctactgctgcagctcctgccgcccggcctgctcccgggctgcgcgatcttccaggacctgatccgctatgggaaaaccaagtgtggggagccgtcgcgccccgccgcctgccgagcctttgatgtccccaagagatatttttcccacttttatatcatctcagtgctgtggaatggcttcctgctttggtgccttactcaatctctgttcctgggagcaccttttccaagctggcttcatggtttgctcagaattctcggggcggcacagttccagggaggggagctggcactgtctgcattcttagtgctagtatttctgtggctgcacagcttacgaagactcttcgagtgcctctacgtcagtgtcttctccaatgtcatgattcacgtcgtgcagtactgttttggacttgtctattatgtccttgttggcctaactgtgctgagccaagtgccaatggatggcaggaatgcctacataacagggaaaaatctattgatgcaagcacggtggttccatattcttgggatgatgatgttcatctggtcatctgcccatcagtataagtgccatgttattctcggcaatctcaggaaaaataaagcaggagtggtcattcactgtaaccacaggatcccatttggagactggtttgaatatgtttcttcccctaactacttagcagagctgatgatctacgtttccatggccgtcacctttgggttccacaacttaacttggtggctagtggtgacaaatgtcttctttaatcaggccctgtctgcctttctcagccaccaattctacaaaagcaaatttgtctcttacccgaagcataggaaagctttcctaccatttttgttttaagttaacctcagtcatgaagaatgcaaaccaggtgatggtttcaatgcctaaggacagtgaagtctggagcccaaagtacagtttcagcaaagctgtttgaaactctccattccatttctataccccacaagttttcactgaatgagcatggcagtgccactcaagaaaatgaatctccaaagtatcttcaaagaataaatactaatggcagataaaaaaaaaaaaaaaaaaa

SEQ ID NO: 108 - protein, 318 aa, Homo Sapiens
MAPWAEAEHSALNPLRAVWLTLTAAFLLTLLLQLLPPGLLPGCAIFQDLIRYGKTKCGEPSRPAACRAFDVPKRYFSHFYIISVLWNGFLLWCLTQSLFLGAPFPSWLHGLLRILGAAQFQGGELALSAFLVLVFLWLHSLRRLFECLYVSVFSNVMIHVVQYCFGLVYYVLVGLTVLSQVPMDGRNAYITGKNLLMQARWFHILGMMMFIWSSAHQYKCHVILGNLRKNKAGVVIHCNHRIPFGDWFEYVSSPNYLAELMIYVSMAVTFGFHNLTWWLVVTNVFFNQALSAFLSHQFYKSKFVSYPKHRKAFLPFLF

SEQ ID NO: 109 - DNA, 957 bp, Homo Sapiens
  CDS (1)...(957)
atggctccctgggcggaggccgagcactcggcgctgaacccgctgcgcgcggtgtggctcacgctgaccgccgccttcctgctgaccctactgctgcagctcctgccgcccggcctgctcccgggctgcgcgatcttccaggacctgatccgctatgggaaaaccaagtgtggggagccgtcgcgccccgccgcctgccgagcctttgatgtccccaagagatatttttcccacttttatatcatctcagtgctgtggaatggcttcctgctttggtgccttactcaatctctgttcctgggagcaccttttccaagctggcttcatggtttgctcagaattctcggggcggcacagttccagggaggggagctggcactgtctgcattcttagtgctagtatttctgtggctgcacagcttacgaagactcttcgagtgcctctacgtcagtgtcttctccaatgtcatgattcacgtcgtgcagtactgttttggacttgtctattatgtccttgttggcctaactgtgctgagccaagtgccaatggatggcaggaatgcctacataacagggaaaaatctattgatgcaagcacggtggttccatattcttgggatgatgatgttcatctggtcatctgcccatcagtataagtgccatgttattctcggcaatctcaggaaaaataaagcaggagtggtcattcactgtaaccacaggatcccatttggagactggtttgaatatgtttcttcccctaactacttagcagagctgatgatctacgtttccatggccgtcacctttgggttccacaacttaacttggtggctagtggtgacaaatgtcttctttaatcaggccctgtctgcctttctcagccaccaattctacaaaagcaaatttgtctcttacccgaagcataggaaagctttcctaccatttttgttttaa

SEQ ID NO: 110 - protein, 209 aa, Artificial Sequence
  Consensus amino acid sequence
AKMPLFNIAKAFAHNHFCTLNGFLGGRYLSYYQPYYLYETIFVSVKADDWYTLFRFLLGIVLFVIGMLINIHSDIILRSKLPQLHVSIDDISLTQWAGAVLFWICNWKQDDLRKPGETGYKIPRGLIRNYAYGICFGGLFELVSCPNYFGEILEWIGFALATWSLPALAFALFTVANLTPRAKAHHKWYLKKFKEKYPKSRKALIPFVL

SEQ ID NO: 111 - protein, 118 aa, Artificial Sequence
  Consensus amino acid sequence
WRFLIGAVLFIICMWVNHQSDMTLRNLRKPGPRGYKIPYGYGNCFGGWFEYVSCPNYFGEICEWIGYALMTWSLPAIAFALMFTCCNMTPRAMAHHKWYHKKFGEEYPKSRKALIPFI

SEQ ID NO: 112 - DNA, 1249 bp, Homo Sapiens
  CDS (53)...(1006)
ggcggaggccgcgccgggagcgcggtggggctaggcgtggggcgctcccggcatgtccctgtaccgcagcgtcgtgtggttcgccaaggggctgcgcgagtacaccaagagtggctatgaatctgcatgtaaagactttgtccctcatgacttggaggtccagattcctggaagagtctttttggtcactggaggaaacagcggcattggcaaagcaactgcccttgaaatcgccaagcgaggtggcacagttcacctggtttgtcgagatcaagccccagcagaagatgccaggggtgagatcatccgagagagcggtaaccagaacatttttctgcacattgtggacttgtctgatcccaagcaaatctggaaatttgttgaaaatttcaagcaggaacataaactccatgttctgatcaataatgcaggttgcatggtcaataaaagagagctcacagaagatggacttgaaaaaaactttgctgccaatactctgggtgtgtacattctcacgaccggcctgatccctgtgctggagaaagaacacgacccccgagtgataaccgtctcctcaggaggaatgttggttcagaaactgaacaccaatgatctccagtccgaaagaacaccatttgatggaactatggtctatgcacaaaacaagaggcagcaagtggttctgacggagcggtgggcccaagggcacccggccatccatttttcttccatgcatcctggctgggccgacaccccaggtgtgaggcaggcgatgccggggttccacgccaggttcggggaccgcctgcgctccgaggcccagggcgcggacaccatgctgtggctggccctctcctctgccgcagccgcacagcccagcggccgcttctttcaagatcggaagccagtttctacacacttgcctctcgctacagcgtcctcctcaccggccgaagaggagaaactcattgaaatcctggaacagctggctcagacatttaaataggccaacccagacacagtgcggtaccagaattgccttagaagataccagaaggtgcggtctagggaccagtgaataagaagaccccacttcaacttcccctcgaagacgttgtgcctcacagcgaggcctacaagggatgggaacttttatttcaaaataaatactaccgaggctgtgatcaggctcaccttgaaaaaaaaaaaaaacctagactcgagcaagcttatgcatgcatgcggccgc

SEQ ID NO: 113 - protein, 317 aa, Homo Sapiens
MSLYRSVVWFAKGLREYTKSGYESACKDFVPHDLEVQIPGRVFLVTGGNSGIGKATALEIAKRGGTVHLVCRDQAPAEDARGEIIRESGNQNIFLHIVDLSDPKQIWKFVENFKQEHKLHVLINNAGCMVNKRELTEDGLEKNFAANTLGVYILTTGLIPVLEKEHDPRVITVSSGGMLVQKLNTNDLQSERTPFDGTMVYAQNKRQQVVLTERWAQGHPAIHFSSMHPGWADTPGVRQAMPGFHARFGDRLRSEAQGADTMLWLALSSAAAAQPSGRFFQDRKPVSTHLPLATASSSPAEEEKLIEILEQLAQTFK

SEQ ID NO: 114 - DNA, 954 bp, Homo Sapiens
  CDS (1)...(954)
atgtccctgtaccgcagcgtcgtgtggttcgccaaggggctgcgcgagtacaccaagagtggctatgaatctgcatgtaaagactttgtccctcatgacttggaggtccagattcctggaagagtctttttggtcactggaggaaacagcggcattggcaaagcaactgcccttgaaatcgccaagcgaggtggcacagttcacctggtttgtcgagatcaagccccagcagaagatgccaggggtgagatcatccgagagagcggtaaccagaacatttttctgcacattgtggacttgtctgatcccaagcaaatctggaaatttgttgaaaatttcaagcaggaacataaactccatgttctgatcaataatgcaggttgcatggtcaataaaagagagctcacagaagatggacttgaaaaaaactttgctgccaatactctgggtgtgtacattctcacgaccggcctgatccctgtgctggagaaagaacacgacccccgagtgataaccgtctcctcaggaggaatgttggttcagaaactgaacaccaatgatctccagtccgaaagaacaccatttgatggaactatggtctatgcacaaaacaagaggcagcaagtggttctgacggagcggtgggcccaagggcacccggccatccatttttcttccatgcatcctggctgggccgacaccccaggtgtgaggcaggcgatgccggggttccacgccaggttcggggaccgcctgcgctccgaggcccagggcgcggacaccatgctgtggctggccctctcctctgccgcagccgcacagcccagcggccgcttctttcaagatcggaagccagtttctacacacttgcctctcgctacagcgtcctcctcaccggccgaagaggagaaactcattgaaatcctggaacagctggctcagacatttaaatag

SEQ ID NO: 115 - protein, 5 aa, Artificial Sequence
  Conserved Motif
  VARIANT (2)...(4): Xaa at positions 2, 3 and 4 can be any amino acid
  VARIANT (1)...(5): Xaa = Any Amino Acid
YXXXK

SEQ ID NO: 116 - protein, 7 aa, Artificial Sequence
  Conserved Motif
  VARIANT (2)...(4): Xaa at positions 2, 3 and 4 can be any amino acid
  VARIANT (6)...(6): Xaa at position 6 can be any amino acid
  VARIANT (1)...(7): Xaa = Any Amino Acid
GXXXGXG

SEQ ID NO: 117 - DNA, 1872 bp, Homo Sapiens
  CDS (346)...(1416)
ttttskmycgrccyyygtcggctttggcgtccgcggggarctgcccctgtgcccgtggctctctgcgcatgcccggaccccggcggctccggagtccgggaggctctggctgctccagtcgcgggtccgggccccgcctctccactcggcggtggcgtccgtgttgttattgtggtggtagcggcgtctggctgctgcggaccccgccgagtcctagcgcctggcctgcgcgccgctgcccgcgccacaggattaatttatttttggaaatcaagtgcaatattggaagccatttctactaattttatttcacttttaaatttatgatttgatttgaatactatcatgggaggagctgtgagtgctggggaagataatgatgacttaattgataatttaaaagaagctcagtatattcgtactgaaagagtggagcaagccttcagagcgattgatcgtggagattactatttggaaggctacagagacaatgcttacaaagacttagcctggaagcatggaaacatccacttgtcagcaccttgcatttattctgaagttatggaagcattgaaacttcaaccaggattgtcttttcttaacctgggaagtggaaccggatatttaagtacaatggtgggcttaattttaggtccttttggaataaatcatgggattgagcttcattcagatgtggtggaatatgccaaggaaaaactggagagcttcatcaaaaatagtgatagctttgataaatttgagttctgtgaacctgcatttgttgttggtaattgcctccagatagcttctgacagtcatcagtatgatcgaatttattgtggagctggagtgcagaaagaccatgaaaactacatgaaaatattactaaaagttggaggcatattagtcatgcctatagaggatcagttaacacagattatgcgaactggacagaacacttgggaaagtaaaaatatccttgctgtttcatttgctccacttgtgcaaccaagtaagaatgataatggcaaaccagattctgtgggactccctccctgtgctgtcaggaatctacaggacttggctcgtatttacattcgacgcacacttagaaatttcataaatgatgagatgcaggccaaggggattcctcaaagggctccacccaaaaggaaaagaaagagagttaaacagagaattaacacttacgtatttgtgggtaatcagcttattcctcagcctctagacagtgaagaggatgaaaaaatggaagaggataacaaagaagaggaggaaaaagatcacaatgaagcaatgaagccagaggagccacctcaaaatttactgagagaaaaaatcatgaagctgcccctccctgaatctttaaaagcttacttgacatattttagagacaaataacttagatcaagaagaaaaatgcctactgataattcctttagtcttgaaaatgtagcatttgttaggagttaaaagagagaattatttctttcatcagagcaaattatagtggaaaaaaaaatcacttgtttctgtcagtaacacaaatgatgtattcagtgaataaaagaatcccttttataaaatctatttttctttaaatcttggaaaaatgttgttttagctcagagtgatttcaaagtggaatgcaacagtagtcaagacttgtgtactataaatccttttctgattccttacagatttgtagtgatgaggtttagatttaattttatatatggtttaaataattgttaagcttatataacctgatctgaattgcagttgtttgcatttcctctatgaaaacttcatttatctaataaggaagtcaaatgctttgtagactatttacct

SEQ ID NO: 118 - protein, 357 aa, Homo Sapiens
MGGAVSAGEDNDDLIDNLKEAQYIRTERVEQAFRAIDRGDYYLEGYRDNAYKDLAWKHGNIHLSAPCIYSEVMEALKLQPGLSFLNLGSGTGYLSTMVGLILGPFGINHGIELHSDVVEYAKEKLESFIKNSDSFDKFEFCEPAFVVGNCLQIASDSHQYDRIYCGAGVQKDHENYMKILLKVGGILVMPIEDQLTQIMRTGQNTWESKNILAVSFAPLVQPSKNDNGKPDSVGLPPCAVRNLQDLARIYIRRTLRNFINDEMQAKGIPQRAPPKRKRKRVKQRINTYVFVGNQLIPQPLDSEEDEKMEEDNKEEEEKDHNEAMKPEEPPQNLLREKIMKLPLPESLKAYLTYFRDK

SEQ ID NO: 119 - DNA, 1074 bp, Homo Sapiens
  CDS (1)...(1074)
atgggaggagctgtgagtgctggggaagataatgatgacttaattgataatttaaaagaagctcagtatattcgtactgaaagagtggagcaagccttcagagcgattgatcgtggagattactatttggaaggctacagagacaatgcttacaaagacttagcctggaagcatggaaacatccacttgtcagcaccttgcatttattctgaagttatggaagcattgaaacttcaaccaggattgtcttttcttaacctgggaagtggaaccggatatttaagtacaatggtgggcttaattttaggtccttttggaataaatcatgggattgagcttcattcagatgtggtggaatatgccaaggaaaaactggagagcttcatcaaaaatagtgatagctttgataaatttgagttctgtgaacctgcatttgttgttggtaattgcctccagatagcttctgacagtcatcagtatgatcgaatttattgtggagctggagtgcagaaagaccatgaaaactacatgaaaatattactaaaagttggaggcatattagtcatgcctatagaggatcagttaacacagattatgcgaactggacagaacacttgggaaagtaaaaatatccttgctgtttcatttgctccacttgtgcaaccaagtaagaatgataatggcaaaccagattctgtgggactccctccctgtgctgtcaggaatctacaggacttggctcgtatttacattcgacgcacacttagaaatttcataaatgatgagatgcaggccaaggggattcctcaaagggctccacccaaaaggaaaagaaagagagttaaacagagaattaacacttacgtatttgtgggtaatcagcttattcctcagcctctagacagtgaagaggatgaaaaaatggaagaggataacaaagaagaggaggaaaaagatcacaatgaagcaatgaagccagaggagccacctcaaaatttactgagagaaaaaatcatgaagctgcccctccctgaatctttaaaagcttacttgacatattttagagacaaataa

SEQ ID NO: 120 - DNA, 3300 bp, Homo Sapiens
  CDS (275)...(2666)
tcgacccacgcgtccgcagggttttgccgtgttgcccaagctggtgtcgaactcctgggctcaagcgatctacccaccttaccctcccaaagtggtgagattacaggtgtgagccaccatgcctggcttctattcttctatgtttgggttttcatcgtcgagctgatgggcctgtagggttaatgacccagagactgcagtaaaggaattagaagctctcttgggttttacattgagagtaggtgttccaaacactcggcctgtgaaaaagacgatggaaattccgaaagattccttgcagaagtacctcaaagacttactgggtatccagaccacaggcccattggaactacttcagtttgatcacgggcagtcaaatccaacttactacatcaggctggctaatcgtgatctagttctgaggaagaagcccccagggacactccttccatctgcccatgccatagagagggagttcaggattatgaaagcccttgcaaatgctggagtacctgtccctaacgttcttgatctctgtgaagattcaagtgtcattggcacccccttctatgtgatggagtactgcccaggtctcatctacaaagacccttccctgccaggcttggagcccagccacagacgagccatatacactgccatgaacacagtcctgtgcaaaattcacagtgtggatctgcaggctgtgggacttgaagactatgggaagcaaggggactatattccacgccaggtacgaacctgggttaagcagtatcgagcttccgaaactagcaccatcccagccatggagaggctgatcgaatggctgcccctccatcttccccgtcagcagaggaccacagtggtgcacggggacttcaggctcgacaacctggtgtttcatccagaagagccagaggtgcttgctgtccttgactgggaactttctaccttgggcgacccccttgctgatgtggcctacagctgcctggctcattacctgccatccagttttcccgtgctgagaggtattaatgactgtgacttgacacagctgggaatccctgctgcagaggagtatttcaggatgtactgtctccaaatggggctccctcccactgagaactggaacttctatatggctttttcctttttccgtgtggctgcaatcctacagggagtctacaagcgatcactcacagggcaagcaagctccacatatgcggaacaaactggaaagctgaccgaatttgtgtctaacctggcgtgggatttcgcagtcaaagaagggttccgggttttcaaagagatgcccttcacaaatccgttaacaaggtcctaccacacgtgggccaggccccagtcccagtggtgccccacaggcagcaggagttatagctccgttccagaagcttccccagctcatacctcaaggggaggtctggttatctctccagagagcctctctccacctgtcagagagctgtatcaccggctgaagcacttcatggagcaacgtgtgtaccctgcagagccagagctgcagagtcaccaggcctcagcagccaggtggagcccctccccactgatcgaagacctcaaggagaaagccaaagctgaaggactttggaaccttttcctacccttagaggctgatcccgagaaaaaatacggagcaggactgaccaatgtggaatatgcacatctgtgtgagctcatgggcacgtccctgtatgcccccgaggtatgtaactgctctgcgcctgacacgggcaacatggagctgctggtgaggtatggcaccgaagcgcagaaggctcgctggctgattcctctgctggaggggaaagcccgctcctgttttgctatgaccgagccccaggttgcctcttcagatgccaccaacattgaggcttccatcagagaggaggacagcttctatgtcataaacggtcacaaatggtggatcacaggcatcctggatcctcgttgccaactctgtgtgtttatgggaaaaacagacccacatgcaccaagacaccggcagcagtctgtgctcttggttcccatggataccccagggataaaaatcatccggcctctgacggtgtatggactggaagatgcaccaggtggccatggtgaagtccgatttgagcacgtgcgtgtgcccaaagagaacatggtcctgggccctggccgaggctttgagatcgcccagggcagactgggccccggcaggatccatcactgcatgaggctgatcgggttctcagagagggccctggcactcatgaaggcccgcgtgaagtcccgcttggcttttgggaagcccctggtggagcagggcacagtgctggcggacatcgcgcagtcgcgcgtggagattgagcaggcacggctgctggtgctgagagctgcccacctcatggacctggcaggaaacaaggctgcagccttggatatagccatgattaaaatggtcgccccgtccatggcctcccgagtgattgatcgtgcgattcaggcctttggagcagcaggcctgagcagcgactacccactggctcagttcttcacctgggcccgagccctgcgctttgccgacggccctgacgaggtgcaccgggccacggtggccaagctagagctgaagcaccgcatttagagccttggggctgcagtggctcaatgtcctggctggtccagctgtgcccagatctgtcactgatgtgcctcgaaagatccggtgtttgtggctcctgcaccctgctcagcagctctgtcccgggacagtcagggtggactcaatctttctggttctccacagaagacgtctctgcaagaagcctggagtctgtttcaggccaggaggaggggatttgctgagggccaagggggttctgggacagagtctggaaagctggtcttcaggctctcagtcccaggctgggcaggcacggtcacttcacttcagcctttcagtccctctctctctgcctgtgggaatctggacacattttgggaggcctcccaaggctgtgggacgtgcttgctctggcagctgcagggttcctgtctggcctccctggtgagcagaggggcggccacggcgggcggtggcctagagacccaggacctgggcgcctgggaaaatggaatgcaacccacattgtaaagccactggcatctgattatctccatttgaacacacagcacagaacaatcatttaaatgttattttggaaaggggttttggggacacagaagaataagtaaacacaaaaaaaaaaaaaaaaa

SEQ ID NO: 121 - protein, 797 aa, Homo Sapiens [sequence omitted]

SEQ ID NO: 122 - DNA, 2394 bp, Homo Sapiens
  CDS (1)...(2394)
atggaaattccgaaagattccttgcagaagtacctcaaagacttactgggtatccagaccacaggcccattggaactacttcagtttgatcacgggcagtcaaatccaacttactacatcaggctggctaatcgtgatctagttctgaggaagaagcccccagggacactccttccatctgcccatgccatagagagggagttcaggattatgaaagcccttgcaaatgctggagtacctgtccctaacgttcttgatctctgtgaagattcaagtgtcattggcacccccttctatgtgatggagtactgcccaggtctcatctacaaagacccttccctgccaggcttggagcccagccacagacgagccatatacactgccatgaacacagtcctgtgcaaaattcacagtgtggatctgcaggctgtgggacttgaagactatgggaagcaaggggactatattccacgccaggtacgaacctgggttaagcagtatcgagcttccgaaactagcaccatcccagccatggagaggctgatcgaatggctgcccctccatcttccccgtcagcagaggaccacagtggtgcacggggacttcaggctcgacaacctggtgtttcatccagaagagccagaggtgcttgctgtccttgactgggaactttctaccttgggcgacccccttgctgatgtggcctacagctgcctggctcattacctgccatccagttttcccgtgctgagaggtattaatgactgtgacttgacacagctgggaatccctgctgcagaggagtatttcaggatgtactgtctccaaatggggctccctcccactgagaactggaacttctatatggctttttcctttttccgtgtggctgcaatcctacagggagtctacaagcgatcactcacagggcaagcaagctccacatatgcggaacaaactggaaagctgaccgaatttgtgtctaacctggcgtgggatttcgcagtcaaagaagggttccgggttttcaaagagatgcccttcacaaatccgttaacaaggtcctaccacacgtgggccaggccccagtcccagtggtgccccacaggcagcaggagttatagctccgttccagaagcttccccagctcatacctcaaggggaggtctggttatctctccagagagcctctctccacctgtcagagagctgtatcaccggctgaagcacttcatggagcaacgtgtgtaccctgcagagccagagctgcagagtcaccaggcctcagcagccaggtggagcccctccccactgatcgaagacctcaaggagaaagccaaagctgaaggactttggaaccttttcctacccttagaggctgatcccgagaaaaaatacggagcaggactgaccaatgtggaatatgcacatctgtgtgagctcatgggcacgtccctgtatgcccccgaggtatgtaactgctctgcgcctgacacgggcaacatggagctgctggtgaggtatggcaccgaagcgcagaaggctcgctggctgattcctctgctggaggggaaagcccgctcctgttttgctatgaccgagccccaggttgcctcttcagatgccaccaacattgaggcttccatcagagaggaggacagcttctatgtcataaacggtcacaaatggtggatcacaggcatcctggatcctcgttgccaactctgtgtgtttatgggaaaaacagacccacatgcaccaagacaccggcagcagtctgtgctcttggttcccatggataccccagggataaaaatcatccggcctctgacggtgtatggactggaagatgcaccaggtggccatggtgaagtccgatttgagcacgtgcgtgtgcccaaagagaacatggtcctgggccctggccgaggctttgagatcgcccagggcagactgggccccggcaggatccatcactgcatgaggctgatcgggttctcagagagggccctggcactcatgaaggcccgcgtgaagtcccgcttggcttttgggaagcccctggtggagcagggcacagtgctggcggacatcgcgcagtcgcgcgtggagattgagcaggcacggctgctggtgctgagagctgcccacctcatggacctggcaggaaacaaggctgcagccttggatatagccatgattaaaatggtcgccccgtccatggcctcccgagtgattgatcgtgcgattcaggcctttggagcagcaggcctgagcagcgactacccactggctcagttcttcacctgggcccgagccctgcgctttgccgacggccctgacgaggtgcaccgggccacggtggccaagctagagctgaagcaccgcatttag

SEQ ID NO: 123 - protein, 28 aa, Artificial Sequence
  Consensus amino acid sequence
QNPILKFGSEEQKKKYLPQLTSGDLIGA

SEQ ID NO: 124 - protein, 80 aa, Artificial Sequence
  Consensus amino acid sequence
ALTEPGAGSDVGSLKTTAEKKEGDDYILNGSKMWITNGGQADWYIVLAVTDPAKKVPGKKGITAFLVEKDTPGFSIGKKE

SEQ ID NO: 125 - protein, 15 aa, Artificial Sequence
  Consensus amino acid sequence
ELIFEDVRVPESNIL

SEQ ID NO: 126 - protein, 156 aa, Artificial Sequence
  Consensus amino acid sequence
GKGFKYAMKELDMERLVIAAQALGLAQGALDEAINYAKQRKQFGKPLADFQLIQFKLADMATKLEAARLLVYRAAWLADRGEDAKEALPTSKEAAMAKLFASEAAMQVATDAVQILGGVGYTKDYPVERFYRDAKITQIYEGTSEIQRLVIARALL

SEQ ID NO: 127 - DNA, 2528 bp, Homo Sapiens
  CDS (133)...(2310)
cccaaaggtaggctcaggctccgacggtggcccgcgggggtcacgaggcttcgtagtggaggaacgggtttggcgtgtgggacgcagctgcctctgtactggggagtcacggagtggccgggctccagggacatggcggcggcctctgcggtgtcggtgctgctggtggcggcggagaggaaccggtggcatcgtctcccgagcctgctcctgccgccgaggacatgggtgtggaggcaaagaaccatgaagtacacaacagccacaggaagaaacattaccaaggtcctcattgcaaacagaggagaaattgcctgcagggtgatgcgcacagccaaaaaactgggtgtacagactgtggcggtttatagtgaggctgacagaaattccatgcatgtagatatggcagatgaagcatattccatcggccccgctccctcccagcagagctacctatctatggagaaaatcattcaagtggccaagacctctgctgcacaggctatccatccaggatgcggttttctttcagaaaacatggaatttgctgaactttgtaagcaagaaggaattatttttataggccctcctccatctgcaattagagacatgggtataaagagcacatccaaatccataatggctgctgctggagtacctgttgtggagggttatcatggtgaggaccaatcagaccagtgcctgaaggaacacgccaggagaattggctatcctgtcatgattaaagccgtccggggtggaggaggaaaaggaatgaggattgttagatcagaacaagaatttcaagaacagttagagtcagcacggagagaagctaagaagtctttcaatgatgatgctatgctgatcgagaagtttgtagacacaccgaggcatgtagaagtccaggtgtttggtgatcaccatggcaatgctgtgtacttgtttgaaagagactgtagtgtgcagaggcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagctggtcgtgtgggcagcagatcgccaggcggcattgacaaaactgaggtacagccttcgtcagtacaatattgttggactgcacaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactcagggcggccccttagctcctatgactggaaccattgaaaaggtgtttgtcaaagctggagacaaagtgaaagcgggagattccctcatggttatgatcgccatgaagatggagcataccataaagtctccaaaggatggcacagtaaagaaagtgttctacagagaaggtgctcaggccaacagacacactcctttagtcgagtttgaggaggaagaatcagacaaaagggaatcggaataaactccagcaaggaaatggccagttaagtagtgtcttctctctccaccaaaaagaggaagtgcctccagcttttctgggggtctcataaagagcagttttactaaatgattgtatgcttatgctgaacacctttcatattggagaatcatgcatttgggtcactaattatctcaaaatatttcatactaataaagttgaattattttttattggaagcc

SEQ ID NO: 128 - protein, 725 aa, Homo Sapiens
MAAASAVSVLLVAAERNRWHRLPSLLLPPRTWVWRQRTMKYTTATGRNITKVLIANRGEIACRVMRTAKKLGVQTVAVYSEADRNSMHVDMADEAYSIGPAPSQQSYLSMEKIIQVAKTSAAQAIHPGCGFLSENMEFAELCKQEGIIFIGPPPSAIRDMGIKSTSKSIMAAAGVPVVEGYHGEDQSDQCLKEHARRIGYPVMIKAVRGGGGKGMRIVRSEQEFQEQLESARREAKKSFNDDAMLIEKFVDTPRHVEVQVFGDHHGNAVYLFERDCSVQRRHQKIIEEAPAPGIKSEVRKKLGEAAVRAAKAVNYVGAGTVEFIMDSKHNFCFMEMNTRLQVEHPVTEMITGTDLVEWQLRIAAGEKIPLSQEEITLQGHAFEARIYAEDPSNNFMPVAGPLVHLSTPRADPSTRIETGVRQGDEVSVHYDPMIAKLVVWAADRQAALTKLRYSLRQYNIVGLHTNIDFLLNLSGHPEFEAGNVHTDFIPQHHKQLLLSRKAAAKESLCQAALGLILKEKAMTDTFTLQAHDQFSPFSSSSGRRLNISYTRNMTLKDGKNNVAIAVTYNHDGSYSMQIEDKTFQVLGNLYSEGDCTYLKCSVNGVASKAKLIILENTIYLFSKEGSIEIDIPVPKYLSSVSSQETQGGPLAPMTGTIEKVFVKAGDKVKAGDSLMVMIAMKMEHTIKSPKDGTVKKVFYREGAQANRHTPLVEFEEEESDKRESE

SEQ ID NO: 129 - DNA, 2178 bp, Homo Sapiens
  CDS (1)...(2178)
atggcggcggcctctgcggtgtcggtgctgctggtggcggcggagaggaaccggtggcatcgtctcccgagcctgctcctgccgccgaggacatgggtgtggaggcaaagaaccatgaagtacacaacagccacaggaagaaacattaccaaggtcctcattgcaaacagaggagaaattgcctgcagggtgatgcgcacagccaaaaaactgggtgtacagactgtggcggtttatagtgaggctgacagaaattccatgcatgtagatatggcagatgaagcatattccatcggccccgctccctcccagcagagctacctatctatggagaaaatcattcaagtggccaagacctctgctgcacaggctatccatccaggatgcggttttctttcagaaaacatggaatttgctgaactttgtaagcaagaaggaattatttttataggccctcctccatctgcaattagagacatgggtataaagagcacatccaaatccataatggctgctgctggagtacctgttgtggagggttatcatggtgaggaccaatcagaccagtgcctgaaggaacacgccaggagaattggctatcctgtcatgattaaagccgtccggggtggaggaggaaaaggaatgaggattgttagatcagaacaagaatttcaagaacagttagagtcagcacggagagaagctaagaagtctttcaatgatgatgctatgctgatcgagaagtttgtagacacaccgaggcatgtagaagtccaggtgtttggtgatcaccatggcaatgctgtgtacttgtttgaaagagactgtagtgtgcagaggcgacatcagaagatcattgaggaggccccagcgcctggtattaaatctgaagtaagaaaaaagctgggagaagctgcagtcagagctgctaaagctgtaaattatgttggagcagggactgtggagtttattatggactcaaaacataatttctgtttcatggagatgaatacaaggctgcaagtggaacatcctgttactgagatgatcacaggaactgacttggtggagtggcagcttagaattgcagcaggagagaagattcctttgagccaggaagaaataactctgcagggccatgccttcgaagctagaatatatgcagaagatcctagcaataacttcatgcctgtggcaggcccattagtgcacctctctactcctcgagcagacccttccaccaggattgaaactggagtacggcaaggagacgaagtttccgtgcattatgaccccatgattgcgaagctggtcgtgtgggcagcagatcgccaggcggcattgacaaaactgaggtacagccttcgtcagtacaatattgttggactgcacaccaacattgacttcttactcaacctgtctggccacccagagtttgaagctgggaacgtgcacactgatttcatccctcaacaccacaaacagttgttgctcagtcggaaggctgcagccaaagagtctttatgccaggcagccctgggtctcatcctcaaggagaaagccatgaccgacactttcactcttcaggcacatgatcaattctctccattttcgtctagcagtggaagaagactgaatatctcgtataccagaaacatgactcttaaagatggtaaaaacaatgtagccatagctgtaacgtataaccatgatgggtcttatagcatgcagattgaagataaaactttccaagtccttggtaatctttacagcgagggagactgcacttacctgaaatgttctgttaatggagttgctagtaaagcgaagctgattatcctggaaaacactatttacctattttccaaggaaggaagtattgagattgacattccagtccccaaatacttatcttctgtgagctcacaagaaactcagggcggccccttagctcctatgactggaaccattgaaaaggtgtttgtcaaagctggagacaaagtgaaagcgggagattccctcatggttatgatcgccatgaagatggagcataccataaagtctccaaaggatggcacagtaaagaaagtgttctacagagaaggtgctcaggccaacagacacactcctttagtcgagtttgaggaggaagaatcagacaaaagggaatcggaataa

SEQ ID NO: 130 - protein, 129 aa, Artificial Sequence
  Consensus amino acid sequence
DIDKVLIANRGEIAIGQAREFDYSGYETFDERIQAVAALSEEDLANTILVNPADATVQTGPGLADKVYFLPKTYLNVDKIIEAARPDGVLATHGGYGFLNENAELAEAGVLEEYGVKFLGPPAEAIRAM

SEQ ID NO: 131 - protein, 262 aa, Artificial Sequence
  Consensus amino acid sequence
DKISFKAAMKEAGVPTVPSSAGPRVDTVHVDKTLVVPDDLYKGLVESAEEALAAAKEIGYPVIIKAAFGGGGKGMRIARNEEELIELFAQALAEAPAAFGNPQVLVEKSLKGPKHIEYQVLADAHGNCITLCNRECSDQRGIRTQKSIEVAPSQTLTDEERQMLREAAVKIARHVGYVGAGTVEFLLDPDSGEFYFIEVNPRLQVEHPLTEKATGYPLAKEQAKIALGIPLPELKNIVTGGTTACFEPSLDYVVVKIPRWDL

SEQ ID NO: 132 - protein, 117 aa, Artificial Sequence
  Consensus amino acid sequence
ECRINAEDPAKGFFLPSPGRITAYRSPEERAGGPGVRVDSGGVYAGYEISPYYDSMIAKLIVWGEDREEAIARMKRALKEFRIRGVKTNIPFLIALLEDPDFLSGNEGAFVTTKFLD

SEQ ID NO: 133 - protein, 75 aa, Artificial Sequence
  Consensus amino acid sequence
KEIKSPMIGESVKEGTPVAEVLVKVGDKVKAGQVLCEVEAMKMEMEIPAPVAGVVKEILVKEGDTVEVGDPLAKI

SEQ ID NO: 134 - protein, 158 aa, Artificial Sequence
  Consensus amino acid sequence
HKQLLLSRKAAAKESLCQAALGLILKEKAMTDTFTLQAHDQFSPFSSSSGRRLNISYTRNMTLKDGKNNVAIAVTYNHDGSYSMQIEDKTFQVLGNLYSEGDCTYLKCSVNGVASKAKLIILENTIYLFSKEGSIEIDIPVPKYLSSVSSQETQGGPL

SEQ ID NO: 135 - protein, 725 aa, Homo Sapiens; identical to SEQ ID NO: 128

SEQ ID NO: 136 - protein, 563 aa, Homo Sapiens
MWAVLRLALRPCARASPAGPRAYHGDSVASLGTQPDLGSALYQENYKQMKALVNQLHERVEHIKLGGGEKARALHISRGKLLPRERIDNLIDPGSPFLELSQFAGYQLYDNEEVPGGGIITGIGRVSGVECMIIANDATVKGGAYYPVTVKKQLRAQEIAMQNRLPCIYLVDSGGAYLPRQADVFPDRDHFGRTFYNQAIMSSKNIAQIAVVMGSCTAGGAYVPAMADENIIVRKQGTIFLAGPPLVKAATGEEVSAEDLGGADLHCRKSGVSDHWALDDHHALHLTRKVVRNLNYQKKLDVTIEPSEEPLFPADELYGIVGANLKRSFDVREVIARIVDGSRFTEFKAFYGDTLVTGFARIFGYPVGIVGNNGVLFSESAKKGTHFVQLCCQRNIPLLFLQNITGFMVGREYEAEGIAKDGAKMVAAVACAQVPKITLIIGGSYGAGNYGMCGRAYSPRFLYIWPNARISVMGGEQAANVLATITKDQRAREGKQFSSADEAALKEPIIKKFEEEGNPYYSSARVWDDGIIDPADTRLVLGLSFSAALNAPIEKTDFGIFRM

SEQ ID NO: 137 - DNA, 1692 bp, Homo Sapiens
atgtgggccgtcctgaggttagccctgcggccgtgtgcccgcgcctctcccgccgggccgcgcgcctatcacggggactcggtggcctcgctgggcacccagccggacttgggctctgccctctaccaggagaactacaagcagatgaaagcactagtaaatcagctccatgaacgagtggagcatataaaactaggaggtggtgagaaagcccgagcacttcacatatcaagaggaaaactattgcccagagaaagaattgacaatctcatagacccagggtctccatttctggaattatcccagtttgcaggttaccagttatatgacaatgaggaggtgccaggaggtggcattattacaggcattggaagagtatcaggagtagaatgcatgattattgccaatgatgccaccgtcaaaggaggtgcctactacccagtgactgtgaaaaaacaattacgggcccaagaaattgccatgcaaaacaggctcccctgcatctacttagttgattcgggaggagcatacttacctcgacaagcagatgtgtttccagatcgagaccactttggccgtacattctataatcaggcaattatgtcttctaaaaatattgcacagatcgcagtggtcatgggctcctgcaccgcaggaggagcctatgtgcctgccatggctgatgaaaacatcattgtacgcaagcagggtaccattttcttggcaggaccccccttggttaaagcggcaactggggaagaagtatctgctgaggatcttggaggtgctgatcttcattgcagaaagtctggagtaagtgaccactgggctttggatgatcatcatgcccttcacttaactaggaaggttgtgaggaatctaaattatcagaagaaattggatgtcaccattgaaccttctgaagagcctttatttcctgctgatgaattgtatggaatagttggtgctaaccttaagaggagctttgatgtccgagaggtcattgctagaatcgtggatggaagcagattcactgagttcaaagccttttatggagacacattagttacaggatttgctcgaatatttgggtacccagtaggtatcgttggaaacaacggagttctcttttctgaatctgcaaaaaagggtactcactttgtccagttatgctgccaaagaaatattcctctgctgttccttcaaaacattactggatttatggttggtagagagtatgaagctgaaggaattgccaaggatggtgccaagatggtggccgctgtggcctgtgcccaagtgcctaagataaccctcatcattgggggctcctatggagccggaaactatgggatgtgtggcagagcgtatagcccaagatttctctacatttggccaaatgctcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaagaggaaggaaacccttactattccagcgcaagggtatgggatgatgggatcattgatccagcagacaccagactggtcttgggtctcagttttagtgcagccctcaacgcaccaatagagaagactgacttcggtatcttcaggatgtaa

SEQ ID NO: 138 - protein, 593 aa, Artificial Sequence
  Consensus amino acid sequence
LNKAGMGGGEKAVKTPEHPRGKLTARERIDLLLDPGSPFGELEDLAFHRATEFGRQADKRKLPGDGVVTGSGAIIGRAVEVFAQDFTVFGGSLGPEHGFKYLYITRAMELAIKANSVATEHVVEESGAPLIGINDSGGAEDGKPRIQEGVESLAGYGLIFGANSRASGPQISLVTGPCAGGGAYSPALTDFIIMVKDPTSPMFLTGPDVIKKVTGREEVTSEELGGADTHMSKSGVAHLTAEDDLDALALVRRLLSYLPKPRSNNMEPPPIVETGDPPDRSVEELRTDDLDVSIVPDDPNKPYDVREVIARIVDEDGKKWLSGLFDEGSFLEIKAGWAKNIVTGFARLGGIPVGVVANQPRTVENIIPADPANPDSKEQVIVLAGQVLDIDSADKAARFIRFCDAGFNIPLVILVDVPGFLPGTDQEYGGIIKHGAKLLYALAEATVPKITVITRAGKAYGGAYVVMDSKILGADFVEMYFAWPTARIAVMGPEGAVEILFRKELAAAAMERLDPTYKDLEALLEKLSEAQEDRKQKIAEYEEELANPYVAAARGFVDAVIDPGETRAKLVIALALLWTKRRRFFPWRKHGNI

SEQ ID NO: 139 - DNA, 2864 bp, Homo Sapiens
  CDS (141)...(2675)
cgagttcacccgcggcggagggtaactttgctgtgctgttttttgagcagttgtctggtccctggaagtgtagcatcgagagagttttctaattacgtttacaaaatatcttccctttggccatacaagtggtgactgccatgtcgaactcgcggcccaggtcccgccgagacgccgggggtggcgctggggcagccggccgggacgagctggtgtcgcggtccttgcagagcgcagagcactgtctgggcgtccaggacttcggcactgcctatgcccactacctcctcgtgctcagcctggcgccggagctgaaacacgacgtgaaggaaacttttcagtacacacttttcagatgggctgaagagcttgatgctctcagtcggatacaagacttacttggttgctatgagcaggccttggaactgtttcctgatgatgaagtgatttgcaatagtatgggggagcatctcttcagaatgggctttagggatgaagcagctgggtattttcataaagcagtgaagctaaaccctgatttcagtgatgcaaaggagaatttttatcgtgttgcaaactggttggtggaacgctggcactttatcatgcttaatgacaccaagaggaatacaatttataatgcagcaatccaaaaggcagtttgtttggggtccaaaagtgttttggacattggagcaggaactggaatactaagcatgtttgctaaaaaagctggagcacattccgtgtatgcctgtgagttatccaagaccatgtatgaacttgcctgtgatgtcgtggcagcaaacaagatggaagcagggatcaaactcttacatacgaagtcacttgacatagagattccaaaacatattcccgaaagagtgtccctagttgtaacagaaactgtcgatgcaggtttatttggagaaggaattgtggagagtttgattcatgcatgggagcatttacttttacagccaaagaccaaaggtgaaagtgctaattgtgaaaagtatgggaaagttataccagcaagtgctgttatatttgggatggcagtagaatgtgcagagataagaagacatcatagagtgggtattaaggacattgctggtatccatttgccaacaaatgtgaaatttcagagtccggcttattcttctgtagatactgaagaaacaattgaaccttatacaactgaaaagatgagtcgagttcctggaggatatttggctttgacagagtgctttgaaattatgacagtagatttcaacaaccttcaggaattaaaaagtcttgcaactaaaaagcctgataagattggtattcctgttattaaagaaggcatactagatgctattatggtttggtttgtgctccagcttgatgatgaacatagtttatccacaagtcctagtgaggaaacatgttgggaacaggctgtctaccccgtacaggaccttgcagactactggataaagcctggagaccatgtgatgatggaagtatcttgtcaagactgttacttaagaatccagagtattagtgtcttgggtttggaatgtgaaatggatgttgcaaaaagttttacccagaataaagacttgttatcgttaggaaatgaggctgaactttgtagtgccctcgctaaccttcagaccagtaaaccagatgctgtagagcagacatgtatattggaatctacagaaattgctttgcttaacaacatcccatatcatgaaggctttaaaatggcaatgagcaaagttttgtcttcactgactccagagaaactgtatcagaccatggatactcactgtcagaatgagatgagctctggaactggacagagtaatactgtacagaacatccttgaacctttctacgtgttagatgtgtccgaaggcttctctgttctgcctgttattgctggcacacttgggcaggttaaaccatacagttctgtggagaaagaccagcatcgtattgctctggacctcatatctgaagccaatcactttcctaaagaaacacttgagttttggctgagacatgtggaggatgaatctgctatgttacaaaggccaaaatcagacaagttatggagcataattatattggatgtcattgagccatctgggctcattcagcaggaaataatggaaaaagctgcaatatccaggtgtttactacaatctggaggcaagatctttcctcagtatgtgctgatgtttgggttgcttgtggaatcacagacactcctagaggagaatgctgttcaaggaacagaacgtactcttggattaaatatagcaccttttattaaccagtttcaggtacctatacgtgtatttttggacctatcctcattgccctgtatacctttaagcaagccagtggaactcttaagactagatttaatgactccgtatttgaacacctctaacagagaagtaaaggtatacgtttgtaaatctggaagactgactgctattccattttggtatcatatgtaccttgatgaagagattaggttggatacttcaagtgaagcctcccactggaaacaagctgcagttgttttagataatcccatccaggttgaaatgggagaggaacttgtactcagcattcagcatcacaaaagcaatgtcagcatcacagtaaagcaatgaagagcagttttccaatgaaaactgtgtaaatagagcatcaacaagtacaaaattcttgtcttaattagtgggggtatataaaaattccttgtaatggtcaaatattttttaaaattgacattaataaagcatattttaaaagattctaaataaaagggtagcattattatagaaaaaaaaaaaaaa

SEQ ID NO: 140 - protein, 845 aa, Homo Sapiens
MSNSRPRSRRDAGGGAGAAGRDELVSRSLQSAEHCLGVQDFGTAYAHYLLVLSLAPELKHDVKETFQYTLFRWAEELDALSRIQDLLGCYEQALELFPDDEVICNSMGEHLFRMGFRDEAAGYFHKAVKLNPDFSDAKENFYRVANWLVERWHFIMLNDTKRNTIYNAAIQKAVCLGSKSVLDIGAGTGILSMFAKKAGAHSVYACELSKTMYELACDVVAANKMEAGIKLLHTKSLDIEIPKHIPERVSLVVTETVDAGLFGEGIVESLIHAWEHLLLQPKTKGESANCEKYGKVIPASAVIFGMAVECAEIRRHHRVGIKDIAGIHLPTNVKFQSPAYSSVDTEETIEPYTTEKMSRVPGGYLALTECFEIMTVDFNNLQELKSLATKKPDKIGIPVIKEGILDAIMVWFVLQLDDEHSLSTSPSEETCWEQAVYPVQDLADYWIKPGDHVMMEVSCQDCYLRIQSISVLGLECEMDVAKSFTQNKDLLSLGNEAELCSALANLQTSKPDAVEQTCILESTEIALLNNIPYHEGFKMAMSKVLSSLTPEKLYQTMDTHCQNEMSSGTGQSNTVQNILEPFYVLDVSEGFSVLPVIAGTLGQVKPYSSVEKDQHRIALDLISEANHFPKETLEFWLRHVEDESAMLQRPKSDKLWSIIILDVIEPSGLIQQEIMEKAAISRCLLQSGGKIFPQYVLMFGLLVESQTLLEENAVQGTERTLGLNIAPFINQFQVPIRVFLDLSSLPCIPLSKPVELLRLDLMTPYLNTSNREVKVYVCKSGRLTAIPFWYHMYLDEEIRLDTSSEASHWKQAAVVLDNPIQVEMGEELVLSIQHHKSNVSITVKQ

SEQ ID NO: 141 - DNA, 2538 bp, Homo Sapiens
  CDS (1)...(2538)
atgtcgaactcgcggcccaggtcccgccgagacgccgggggtggcgctggggcagccggccgggacgagctggtgtcgcggtccttgcagagcgcagagcactgtctgggcgtccaggacttcggcactgcctatgcccactacctcctcgtgctcagcctggcgccggagctgaaacacgacgtgaaggaaacttttcagtacacacttttcagatgggctgaagagcttgatgctctcagtcggatacaagacttacttggttgctatgagcaggccttggaactgtttcctgatgatgaagtgatttgcaatagtatgggggagcatctcttcagaatgggctttagggatgaagcagctgggtattttcataaagcagtgaagctaaaccctgatttcagtgatgcaaaggagaatttttatcgtgttgcaaactggttggtggaacgctggcactttatcatgcttaatgacaccaagaggaatacaatttataatgcagcaatccaaaaggcagtttgtttggggtccaaaagtgttttggacattggagcaggaactggaatactaagcatgtttgctaaaaaagctggagcacattccgtgtatgcctgtgagttatccaagaccatgtatgaacttgcctgtgatgtcgtggcagcaaacaagatggaagcagggatcaaactcttacatacgaagtcacttgacatagagattccaaaacatattcccgaaagagtgtccctagttgtaacagaaactgtcgatgcaggtttatttggagaaggaattgtggagagtttgattcatgcatgggagcatttacttttacagccaaagaccaaaggtgaaagtgctaattgtgaaaagtatgggaaagttataccagcaagtgctgttatatttgggatggcagtagaatgtgcagagataagaagacatcatagagtgggtattaaggacattgctggtatccatttgccaacaaatgtgaaatttcagagtccggcttattcttctgtagatactgaagaaacaattgaaccttatacaactgaaaagatgagtcgagttcctggaggatatttggctttgacagagtgctttgaaattatgacagtagatttcaacaaccttcaggaattaaaaagtcttgcaactaaaaagcctgataagattggtattcctgttattaaagaaggcatactagatgctattatggtttggtttgtgctccagcttgatgatgaacatagtttatccacaagtcctagtgaggaaacatgttgggaacaggctgtctaccccgtacaggaccttgcagactactggataaagcctggagaccatgtgatgatggaagtatcttgtcaagactgttacttaagaatccagagtattagtgtcttgggtttggaatgtgaaatggatgttgcaaaaagttttacccagaataaagacttgttatcgttaggaaatgaggctgaactttgtagtgccctcgctaaccttcagaccagtaaaccagatgctgtagagcagacatgtatattggaatctacagaaattgctttgcttaacaacatcccatatcatgaaggctttaaaatggcaatgagcaaagttttgtcttcactgactccagagaaactgtatcagaccatggatactcactgtcagaatgagatgagctctggaactggacagagtaatactgtacagaacatccttgaacctttctacgtgttagatgtgtccgaaggcttctctgttctgcctgttattgctggcacacttgggcaggttaaaccatacagttctgtggagaaagaccagcatcgtattgctctggacctcatatctgaagccaatcactttcctaaagaaacacttgagttttggctgagacatgtggaggatgaatctgctatgttacaaaggccaaaatcagacaagttatggagcataattatattggatgtcattgagccatctgggctcattcagcaggaaataatggaaaaagctgcaatatccaggtgtttactacaatctggaggcaagatctttcctcagtatgtgctgatgtttgggttgcttgtggaatcacagacactcctagaggagaatgctgttcaaggaacagaacgtactcttggattaaatatagcaccttttattaaccagtttcaggtacctatacgtgtatttttggacctatcctcattgccctgtatacctttaagcaagccagtggaactcttaagactagatttaatgactccgtatttgaacacctctaacagagaagtaaaggtatacgtttgtaaatctggaagactgactgctattccattttggtatcatatgtaccttgatgaagagattaggttggatacttcaagtgaagcctcccactggaaacaagctgcagttgttttagataatcccatccaggttgaaatgggagaggaacttgtactcagcattcagcatcacaaaagcaatgtcagcatcacagtaaagcaatga

SEQ ID NO: 142 - protein, 9 aa, Artificial Sequence
  Consensus sequence for methyltransferase I motif
  VARIANT (1)...(1): Xaa at position 1 can be Val, Ile or Leu
  VARIANT (2)...(2): Xaa at position 2 can be Val or Leu
  VARIANT (3)...(3): Xaa at position 3 can be Asp or Glu
  VARIANT (4)...(4): Xaa at position 4 can be Val or Ile
  VARIANT (6)...(6): Xaa at position 6 can be Gly or Cys
  VARIANT (8)...(8): Xaa at position 8 can be Thr or Pro
XXXXGXGXG

SEQ ID NO: 143 - protein, 8 aa, Artificial Sequence
  Consensus sequence for methyltransferase II motif
  VARIANT (1)...(1): Xaa at position 1 can be Pro or Gly
  VARIANT (2)...(2): Xaa at position 2 can be Gln or Thr
  VARIANT (3)...(3): Xaa at position 3 can be Phe, Tyr or Ala
  VARIANT (6)...(6): Xaa at position 6 can be Ile, Val or Tyr
  VARIANT (7)...(7): Xaa at position 7 can be Phe or Ile
  VARIANT (8)...(8): Xaa at position 8 can be Cys, Val or Leu
XXXDAXXX

SEQ ID NO: 144 - protein, 10 aa, Artificial Sequence
  Consensus sequence for methyltransferase III motif
  VARIANT (3)...(3): Xaa at position 3 can be Arg or Lys
  VARIANT (7)...(7): Xaa at position 7 can be Arg, Ile or Leu
  VARIANT (8)...(8): Xaa at position 8 can be Leu or Ile
  VARIANT (9)...(9): Xaa at position 9 can be Leu, Phe, Ile or Val
  VARIANT (10)...(10): Xaa at position 10 can be Leu or Ile
LLXPGGXXXX

SEQ ID NO: 145 - protein, 448 aa, Mus Musculus
MEAPGEGPCSESQVIPVLEEDPVDYGCEMQLLQDGAQLQLQLQPEEFVAIADYTATDETQLSFLRGEKILILRQTTADWWWGERAGCCGYIPANHLGKQLEEYDPEDTWQDEEYFDSYGTLKLHLEMLADQPRTTKYHSVILQNKESLKDKVILDVGCGTGIISLFCAHHARPKAVYAVEASDMAQHTSQLVLQNGFADTITVFQQKVEDVVLPEKVDVLVSEWMGTCLLFEFMIESILYARDTWLKGDGIIWPTTAALHLVPCSAEKDYHSKVLFWDNAYEFNLSALKSLAIKEFFSRPKSNHILKPEDCLSEPCTILQLDMRTVQVPDLETMRGELRFDIQKAGTLHGFTAWFSVYFQSLEEGQPQQVVSTGPLHPTTHWKQTLFMMDDPVPVHTGDVVHGFCCVTKKSGMEKAHVCLSELGCHVRTRSHVSTELETGSFRSGGDS

SEQ ID NO: 146 - protein, 343 aa, Homo Sapiens
MEVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAKNNRDLDFTIDLDFKGQLCELSCSTDYRMR

SEQ ID NO: 147 - protein, 371 aa, Mus Musculus
MAAAEAANCIMENFVATLANGMSLQPPLEEVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLHARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAKNNRDLDFTIDLDFKGQLCELSCSTDYRMR

SEQ ID NO: 148 - protein, 390 aa, Arabidopsis Thaliana
MTKNSNHDENEFISFEPNQNTKIRFEDADEDEVAEGSGVAGEETPQDESMFDAGESADTAEVTDDTTSADYYFDSYSHFGIHEEMLKDVVRTKTYQNVIYQNKFLIKDKIVLDVGAGTGILSLFCAKAGAAHVYAVECSQMADMAKEIVKANGFSDVITVLKGKIEEIELPTPKVDVIISEWMGYFLLFENMLDSVLYARDKWLVEGGVVLPDKASLHLTAIEDSEYKEDKIEFWNSVYGFDMSCIKKKAMMEPLVDTVDQNQIVTDSRLLKTMDISKMSSGDASFTAPFKLVAQRNDYIHALVAYFDVSFTMCHKLLGFSTGPKSRATHWKQTVLYLEDVLTICEGETITGTMSVSPNKKNPRDIDIKLSYSLNGQHCKISRTQHYKMR

SEQ ID NO: 149 - protein, 348 aa, Saccharomyces Cerevisiae
MSKTAVKDSATEKTKLSESEQHYFNSYDHYGIHEEMLQDTVRTLSYRNAIIQNKDLFKDKIVLDVGCGTGILSMFAAKHGAKHVIGVDMSSIIEMAKELVELNGFSDKITLLRGKLEDVHLPFPKVDIIISEWMGYFLLYESMMDTVLYARDHYLVEGGLIFPDKCSIHLAGLEDSQYKDEKLNYWQDVYGFDYSPFVPLVLHEPIVDTVERNNVNTTSDKLIEFDLNTVKISDLAFKSNFKLTAKRQDMINGIVTWFDIVFPAPKGKRPVEFSTGPHAPYTHWKQTIFYFPDDLDAETGDTIEGELVCSPNEKNNRDLNIKISYKFESNGIDGNSRSRKNEGSYLMH

SEQ ID NO: 150 - protein, 353 aa, Rattus Norvegicus
MAAAEAANCIMEVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLHARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAKNNRDLDFTIDLDFKGQLCELSCSTDYRMR

SEQ ID NO: 151 - DNA, 2625 bp, Homo Sapiens
  CDS (136)...(2151)
gccgccgccgtcgctgacccagcccgccaggcgctcctgaccgtcgcttcctccggtcccaggtccccggccctcgcctcagccccggcccctggtccccagccctcgtcgcagccccggccgcccgccgccgccatgtccaaggaggagcgccccggtcgggaggagatcctggagtgccaggtgatgtgggagcctgacagtaagaagaacacgcagatggaccgcttccgggcggctgtgggcgccgcctgcggcctggcgctggagagttatgatgacttgtaccattggtccgttgagtcatattcagacttctgggcagagttctggaaattcagtggaattgtcttctcacgtgtgtatgatgaggttgtggacacatcgaaaggaatcgcagatgtccccgagtggttcaaaggcagtcggctcaactatgcagaaaacctcctgcggcacaaagagaatgacagagttgccctttacattgcaagggaaggcaaagaggaaattgtgaaggtgacttttgaagagctgaggcaagaagtggctttgtttgcagcagcaatgaggaaaatgggtgtgaagaaaggagatcgggttgttggttatttacccaacagtgagcacgctgtcgaggcgatgctggctgcggcaagcattggtgccatctggagctccacgtccccggacttcggtgtgaatggtgtgctggaccggttttctcaaattcagccaaagctcatcttctctgtggaggctgttgtctataatggcaaagagcacaaccacatggaaaagctgcagcaggtggttaaaggcctaccagacttgaagaaagtggtggtgattccttatgtgtcctccagagagaacatagacctttcaaagattccaaacagtgtgtttctggatgactttcttgccaccggcaccagtgagcaggccccgcagctggagttcgagcagctgcccttcagccacccactgttcatcatgttctcatcgggcaccacgggcgcacccaagtgcatggtgcattccgctgggggcaccctcatccagcatctgaaggagcacctgctgcacggcaacatgaccagcagtgacatcctcctgtgctacaccacggtcggctggatgatgtggaactggatggtgtcccttctggccacaggagcggccatggtcttgtacgatggctcccccctggtgcccacgcccaatgtgctctgggacctggttgacaggataggcatcactgtcctggtaactggggccaagtggctgtcagtgctggaagagaaggccatgaagccggtggaaacccacagtctccagatgctccacacgatcctgtccactggctccccactgaaagcccagagctacgagtatgtctacaggtgcatcaagagcagcatcctcctgggctccatctcaggaggcaccgacatcatctcctgcttcatgggccacaatttttctcttcctgtgtataaaggggagattcaggcccggaacctgggcatggccgtggaagcgtggaacgaggaaggaaaggcggtctggggagagagcggcgagctggtgtgtactaagccgatcccttgccagcccacacacttctggaacgatgagaacggcaacaagtacaggaaggcgtatttctccaaattcccaggtatctgggctcatggcgactactgcagaatcaaccccaagaccgggggcatcgtcatgcttggccggagtgacggcaccctcaaccccaacggggtgcggttcggcagctcggaaatctataacattgtggaatccttcgaggaggtggaggacagcctgtgtgtcccccagtataacaagtacagggaggagagggtgatcctcttcctgaagatggcctccgggcacgccttccagcctgacttggttaagaggatccgtgacgccatccgcatgggcttgtctgcgcgacacgtgcccagcctcatcctggaaaccaagggcatcccgtatacgctcaacggcaagaaagtggaagttgccgtcaaacagatcatcgctggaaaagccgtggagcaaggaggtgctttctcgaaccccgagaccctggatctgtaccgggacatccctgagctgcagggcttctgagtcagactggctggcgtgtcactcagccgcacccgtgtgcactgtaacttttgtgtgctcaagaaattatacagaaacctacagctgttgtaaaaggatgctcgcaccaagtgttctgtaggcttggggagggatcgtttctctgttttgttaaatctggtgggtacctggatcttccacacgagtgggattctggccttcagagaccaggagggagtgtctgggccgcaggtgtggcactgtggtgagagtgtgtgtctttgcacacacagtgcagcgggaacggtggggctggctggtgctgaagacagacacactcctgagccaaggtcttgtcttcaacctccccgtcccgttgtcccattttgctctgtgaaggtgcaaatccctttcttcccttcccatctcaggctctcctgttttccctcagggtccagtatgccctttgagctttagctgttagaaaggaac

SEQ ID NO: 152 - protein, 672 aa, Homo Sapiens
MSKEERPGREEILECQVMWEPDSKKNTQMDRFRAAVGAACGLALESYDDLYHWSVESYSDFWAEFWKFSGIVFSRVYDEVVDTSKGIADVPEWFKGSRLNYAENLLRHKENDRVALYIAREGKEEIVKVTFEELRQEVALFAAAMRKMGVKKGDRVVGYLPNSEHAVEAMLAAASIGAIWSSTSPDFGVNGVLDRFSQIQPKLIFSVEAVVYNGKEHNHMEKLQQVVKGLPDLKKVVVIPYVSSRENIDLSKIPNSVFLDDFLATGTSEQAPQLEFEQLPFSHPLFIMFSSGTTGAPKCMVHSAGGTLIQHLKEHLLHGNMTSSDILLCYTTVGWMMWNWMVSLLATGAAMVLYDGSPLVPTPNVLWDLVDRIGITVLVTGAKWLSVLEEKAMKPVETHSLQMLHTILSTGSPLKAQSYEYVYRCIKSSILLGSISGGTDIISCFMGHNFSLPVYKGEIQARNLGMAVEAWNEEGKAVWGESGELVCTKPIPCQPTHFWNDENGNKYRKAYFSKFPGIWAHGDYCRINPKTGGIVMLGRSDGTLNPNGVRFGSSEIYNIVESFEEVEDSLCVPQYNKYREERVILFLKMASGHAFQPDLVKRIRDAIRMGLSARHVPSLILETKGIPYTLNGKKVEVAVKQIIAGKAVEQGGAFSNPETLDLYRDIPELQGF

SEQ ID NO: 153 - DNA, 2019 bp, Homo Sapiens
  CDS (1)...(2019)
atgtccaaggaggagcgccccggtcgggaggagatcctggagtgccaggtgatgtgggagcctgacagtaagaagaacacgcagatggaccgcttccgggcggctgtgggcgccgcctgcggcctggcgctggagagttatgatgacttgtaccattggtccgttgagtcatattcagacttctgggcagagttctggaaattcagtggaattgtcttctcacgtgtgtatgatgaggttgtggacacatcgaaaggaatcgcagatgtccccgagtggttcaaaggcagtcggctcaactatgcagaaaacctcctgcggcacaaagagaatgacagagttgccctttacattgcaagggaaggcaaagaggaaattgtgaaggtgacttttgaagagctgaggcaagaagtggctttgtttgcagcagcaatgaggaaaatgggtgtgaagaaaggagatcgggttgttggttatttacccaacagtgagcacgctgtcgaggcgatgctggctgcggcaagcattggtgccatctggagctccacgtccccggacttcggtgtgaatggtgtgctggaccggttttctcaaattcagccaaagctcatcttctctgtggaggctgttgtctataatggcaaagagcacaaccacatggaaaagctgcagcaggtggttaaaggcctaccagacttgaagaaagtggtggtgattccttatgtgtcctccagagagaacatagacctttcaaagattccaaacagtgtgtttctggatgactttcttgccaccggcaccagtgagcaggccccgcagctggagttcgagcagctgcccttcagccacccactgttcatcatgttctcatcgggcaccacgggcgcacccaagtgcatggtgcattccgctgggggcaccctcatccagcatctgaaggagcacctgctgcacggcaacatgaccagcagtgacatcctcctgtgctacaccacggtcggctggatgatgtggaactggatggtgtcccttctggccacaggagcggccatggtcttgtacgatggctcccccctggtgcccacgcccaatgtgctctgggacctggttgacaggataggcatcactgtcctggtaactggggccaagtggctgtcagtgctggaagagaaggccatgaagccggtggaaacccacagtctccagatgctccacacgatcctgtccactggctccccactgaaagcccagagctacgagtatgtctacaggtgcatcaagagcagcatcctcctgggctccatctcaggaggcaccgacatcatctcctgcttcatgggccacaatttttctcttcctgtgtataaaggggagattcaggcccggaacctgggcatggccgtggaagcgtggaacgaggaaggaaaggcggtctggggagagagcggcgagctggtgtgtactaagccgatcccttgccagcccacacacttctggaacgatgagaacggcaacaagtacaggaaggcgtatttctccaaattcccaggtatctgggctcatggcgactactgcagaatcaaccccaagaccgggggcatcgtcatgcttggccggagtgacggcaccctcaaccccaacggggtgcggttcggcagctcggaaatctataacattgtggaatccttcgaggaggtggaggacagcctgtgtgtcccccagtataacaagtacagggaggagagggtgatcctcttcctgaagatggcctccgggcacgccttccagcctgacttggttaagaggatccgtgacgccatccgcatgggcttgtctgcgcgacacgtgcccagcctcatcctggaaaccaagggcatcccgtatacgctcaacggcaagaaagtggaagttgccgtcaaacagatcatcgctggaaaagccgtggagcaaggaggtgctttctcgaaccccgagaccctggatctgtaccgggacatccctgagctgcagggcttctga

SEQ ID NO: 154 - protein, 672 aa, Rattus Norvegicus
MSKLARLEREEIMECQVMWEPDSKKDTQMDRFRAAVGTACGLALGNYDDLYHWSVRSYSDFWAEFWKFSGIVCSRMYDEVVDTSKGIADVPEWFRGSRLNYAENLLRHKENDRVALYVAREGREEIAKVTFEELRQQVALFAAAMRKMGVKKGDRVVGYLPNSAHAVEAMLAAASIGAIWSSTSPDFGVNGVLDRFSQIQPKLIFSVEAVVYNGKEHGHLEKLQRVVKGLPDLQRVVLIPYVLPREKIDISKIPNSMFLDDFLASGTGAQAPQLEFEQLPFSHPLFIMFSSGTTGAPKCMVHSAGGTLIQHLKEHVLHGNMTSSDILLYYTTVGWMMWNWMVSALATGASLVLYDGSPLVPTPNVLWDLVDRIGITILGTGAKWLSVLEEKDMKPMETHNLHTLHTILSTGSPLKAQSYEYVYRCIKSTVLLGSISGGTDIISCFMGQNSSIPVYKGEIQARNLGMAVEAWDEEGKTVWGASGELVCTKPIPCQPTHFWNDENGSKYRKAYFSKYPGVWAHGDYCRINPKTGGIVMLGRSDGTLNPNGVRFGSSEIYNIVEAFDEVEDSLCVPQYNRDGEERVVLFLKMASGHTFQPDLVKHIRDAIRLGLSARHVPSLILETQGIPYTINGKKVEVAVKQVIAGKTVEHRGAFSNPESLDLYRDIPELQDF

SEQ ID NO: 155 - protein, 600 aa, Artificial Sequence
  Consensus amino acid sequence
MSKRREEIECQVMWEPDSKKTQMDRFRAAVGACGLALYDDLYHWSVSYSDFWAEFWKFSGIVSRYDEVVDTSKGIADVPEWFGSRLNYAENLLRHKENDRVALYAREGEEIKVTFEELRQVALFAAAMRKMGVKKGDRVVGYLPNSHAVEAMLAAASIGAIWSSTSPDFGVNGVLDRFSQIQPKLIFSVEAVVYNGKEHHEKLQVVKGLPDLVVIPYVREIDSKIPNSFLDDFLAGTQAPQLEFEQLPFSHPLFIMFSSGTTGAPKCMVHSAGGTLIQHLKEHLHGNMTSSDILLYTTVGWMMWNWMVSLATGAVLYDGSPLVPTPNVLWDLVDRIGITLTGAKWLSVLEEKMKPETHLLHTILSTGSPLKAQSYEYVYRCIKSLLGSISGGTDIISCFMGNSPVYKGEIQARNLGMAVEAWEEGKVWGSGELVCTKPIPCQPTHFWNDENGKYRKAYFSKPGWAHGDYCRINPKTGGIVMLGRSDGTLNPNGVRFGSSEIYNIVEFEVEDSLCVPQYNEERVLFLKMASGHFQPDLVKIRDAIRGLSARHVPSLILETGIPYTNGKKVEVAVKQIAGKVEGAFSNPELDLYRDIPELQF

SEQ ID NO: 156 - DNA, 2093 bp, Rattus Norvegicus
ccacgccttgcgctctccgctgtctccgcagctaaagcccgggcagccccggccacgcagctccgcaaccatgtccaagctggcacggctcgagcgcgaggagatcatggagtgccaggtgatgtgggagcctgacagcaagaaggacacgcagatggaccgcttccgggcggccgtgggtactgcctgcggcctggcgcttgggaattacgatgacttataccactggtctgtccggtcgtattcagacttctgggctgagttctggaagttcagtggaattgtctgctctcgcatgtatgatgaggttgtggacacatccaaaggaattgcagatgtccctgagtggttcagaggcagccgcctcaactatgcagagaaccttctgcggcacaaggagaacgacagagtcgccctttacgtggcccgggaaggcagagaggagattgcgaaggtgactttcgaagagcttcggcagcaggtggctctgtttgcagccgccatgaggaagatgggcgtgaagaaaggggaccgtgtggtcggttatctccccaacagtgcccatgccgtggaggccatgctggctgctgccagtattggagccatttggagttctacctcaccagactttggtgtgaatggtgtcctggaccgcttttctcaaattcagccgaaacttatcttctcggtggaagctgtggtctacaacggcaaggaacacggccacctggagaagctgcagcgagtcgtgaaaggacttcctgaccttcagcgagtggtgctgatcccctatgtcctcccaagggagaagatagacatttccaagatccccaacagcatgtttctggatgacttcctggcaagcgggacaggtgcgcaggcaccacagctcgagtttgaacagctgcccttcagccatcccctgttcatcatgttctcctcgggcacgacaggagcgcccaagtgcatggtgcactctgctgggggcaccctcatccagcacctgaaggagcacgtgctacatggcaacatgacaagcagtgacatcctgctctactacaccacggtcggctggatgatgtggaactggatggtgtcagcgctggccacaggagcatccttggttctgtacgatggctccccgctggttccaacacccaatgtgttgtgggaccttgtggacaggataggaatcaccatcctgggaacgggagccaagtggctgtcagtgctggaggagaaggacatgaagccgatggaaactcacaacctccacacgctccacacgatcctgtccaccggctcgccactgaaagcccagagctatgagtatgtgtacagatgcatcaagagcaccgtgctcctcggctccatctcaggtggcactgacatcatctcctgtttcatgggccagaactcatctattcctgtgtacaagggtgagatccaagcccggaacctcggcatggccgtggaagcctgggacgaggaagggaaaaccgtctggggagcgagtggcgagctggtttgcaccaagcccataccctgccagcccacgcacttctggaacgacgagaacggcagcaagtacaggaaggcttacttctccaaatacccaggtgtctgggcacacggcgactactgcaggatcaaccccaagacaggaggtatcgtcatgttgggccggagtgatggcaccctcaaccccaatggcgtacgctttggcagctcggagatctacaacattgtggaagccttcgatgaggtggaggacagcctttgtgtgccccagtacaacagggatggtgaggagcgggtagtcctgtttctgaagatggcctctgggcacactttccagcccgacctcgtgaagcacatccgtgatgccatccgccttggcctgtctgctcgccacgtgcccagcctcatcctggagacccaaggcattccatacacaatcaacggcaagaaagtggaggtggccgtgaagcaggtgatagctgggaagactgtggagcaccggggggccttctccaaccctgagtccctggacctgtatcgggacatccctgagctgcaggacttctgaacca

What is claimed is:

1. An isolated nucleic acid molecule selected from the group consisting of:
    a) a nucleic acid molecule consisting of the nucleotide sequence of SEQ ID NO:68; and
    b) a nucleic acid molecule consisting of the nucleotide sequence of SEQ ID NO:66.

2. The nucleic acid molecule of claim 1, wherein the nucleic acid molecule consists of SEQ ID NO:68.

3. The nucleic acid molecule of claim 1, wherein the nucleic acid molecule consists of the nucleic acid sequence of SEQ ID NO:66.

4. An isolated vector comprising the nucleic acid molecule of claim 1.

5. An isolated host cell which contains the vector of claim 2.

6. The host cell of claim 5, which is a mammalian host cell.

7. A method for producing the polypeptide of SEQ ID NO:67, comprising culturing the host cell of claim 5 under conditions in which the nucleic acid molecule is expressed.

8. An isolated non-human mammalian host cell containing the nucleic acid molecule of claim 1.

* * * * *